US012655426B2

(12) United States Patent
Bowen et al.

(10) Patent No.: US 12,655,426 B2
(45) Date of Patent: Jun. 16, 2026

(54) POLYPEPTIDES USEFUL FOR GENE EDITING AND METHODS OF USE

(71) Applicant: LifeEDIT Therapeutics, Inc., Morrisville, NC (US)

(72) Inventors: Tyson D. Bowen, Morrisville, NC (US); Alexandra Briner Crawley, Cary, NC (US); Tedd D. Elich, Durham, NC (US); Mark Moore, Durham, NC (US); Rodolphe Barrangou, Raleigh, NC (US); Michael Lassner, Portland, OR (US)

(73) Assignee: Life Edit Therapeutics, Inc., Durham, NC (US)

( * ) Notice: Subject to any disclaimer, the term of this patent is extended or adjusted under 35 U.S.C. 154(b) by 937 days.

(21) Appl. No.: 17/418,498

(22) PCT Filed: Dec. 20, 2019

(86) PCT No.: PCT/US2019/068079
§ 371 (c)(1),
(2) Date: Jun. 25, 2021

(87) PCT Pub. No.: WO2020/139783
PCT Pub. Date: Jul. 2, 2020

(65) Prior Publication Data
US 2022/0145296 A1 May 12, 2022

Related U.S. Application Data

(60) Provisional application No. 62/785,391, filed on Dec. 27, 2018, provisional application No. 62/790,256, filed on Jan. 9, 2019, provisional application No. 62/790,258, filed on Jan. 9, 2019, provisional application No. 62/790,261, filed on Jan. 9, 2019, provisional application No. 62/790,262, filed on Jan. 9, 2019, provisional application No. 62/790,266, filed on Jan. 9, 2019, provisional application No. 62/932,169, filed on Nov. 7, 2019.

(51) Int. Cl.
| | |
|---|---|
| *C12N 15/113* | (2010.01) |
| *C12N 9/22* | (2006.01) |
| *C12N 9/78* | (2006.01) |

(52) U.S. Cl.
CPC .............. *C12N 15/113* (2013.01); *C12N 9/22* (2013.01); *C12N 9/78* (2013.01); *C12N 2310/20* (2017.05); *C12Y 305/04004* (2013.01)

(58) Field of Classification Search
CPC .......... C12N 15/113; C12N 9/22; C12N 9/78; C12N 2310/20; C12N 15/52; C12Y 305/04004; C07K 2319/00; C07K 2319/80
See application file for complete search history.

(56) References Cited

U.S. PATENT DOCUMENTS

| | | | |
|---|---|---|---|
| 2014/0186919 A1 | 7/2014 | Zhang | |
| 2017/0121693 A1* | 5/2017 | Liu | A61P 7/04 |
| 2018/0362943 A1 | 12/2018 | Chittoor et al. | |
| 2024/0174995 A1* | 5/2024 | Li | A61P 9/00 |

FOREIGN PATENT DOCUMENTS

| | | | | |
|---|---|---|---|---|
| AU | 2015101792 A4 | 1/2016 | | |
| CN | 108513575 A | 9/2018 | | |
| JP | 2015-523856 A | 8/2015 | | |
| WO | WO 2013/176772 A1 | 11/2013 | | |
| WO | WO 2014/089290 | 6/2014 | | |
| WO | WO 2017/062855 A1 | 4/2017 | | |
| WO | WO 2017/070632 A2 | 4/2017 | | |
| WO | WO-2017155717 A1 * | 9/2017 | .......... | C12N 15/113 |
| WO | WO-2018172556 A1 * | 9/2018 | ............ | C12N 15/67 |
| WO | WO 2019/120310 A1 | 6/2019 | | |

OTHER PUBLICATIONS

Pace et al. Sickle Cell Disease: Genetics, Cellular and MolecularMechanisms, and Therapies. Anemia. 2012; 2012: 143594. (Year: 2012).*

(Continued)

*Primary Examiner* — Valarie E Bertoglio
*Assistant Examiner* — Briana N Ebbinghaus
(74) *Attorney, Agent, or Firm* — Womble Bond Dickinson (US) LLP

(57) ABSTRACT

Compositions and methods for binding to a target sequence of interest are provided. Compositions include fusion proteins between DNA binding proteins or protein domains and nucleic acid modifying proteins or protein domains. The compositions find use in cleaving or modifying a target sequence of interest, visualization of a target sequence of interest, and modifying the expression of a sequence of interest. Compositions comprise RNA-guided nuclease polypeptides, CRISPR RNAs, trans-activating CRISPR RNAs, guide RNAs, deaminases, and nucleic acid molecules encoding the same. Vectors and host cells comprising the nucleic acid molecules are also provided. Further provided are CRISPR systems for binding a target sequence of interest, wherein the CRISPR system comprises an RNA-guided nuclease polypeptide and one or more guide RNAs. Also provided are deaminases which may be fused to a DNA-binding polypeptide and may be useful for gene editing.

17 Claims, No Drawings
Specification includes a Sequence Listing.

(56)  References Cited

OTHER PUBLICATIONS

Nowak et al. Guide RNA engineering for versatile Cas9 functionality. Nucleic Acids Res. Nov. 16, 2016; 44(20): 9555-9564. Published online Oct. 12, 2016 . . . (Year: 2016).*

Bernat et al. RNA Structures as Mediators of Neurological Diseases and as Drug Targets. Neuron. Jul. 1, 2015;87(1):28-46. (Year: 2015).*

Lin et al. Engineering the Direct Repeat Sequence of crRNA for Optimization of FnCpf1-Mediated Genome Editing in Human Cells. Mol Ther. Nov. 7, 2018;26(11):2650-2657. (Year: 2018).*

Dörrschuck, E., et al., "Restriction of Porcine Endogenous Retrovirus by Porcine APOBEC3 Cytidine Deaminases," *Journal of Virology*, 2011, vol. 85(8), pp. 3842-3857.

Fujino, T., et al., "C→U editing of apolipoprotein B mRNA in marsupials: identification and characterisation of APOBEC-1 from the American opossum *Monodelphus domestica*," *Nucleic Acids Research*, 1999, vol. 27(13), pp. 2662-2671.

Hultquist, J., et al., "Human and Rhesus APOBEC3D, APOBEC3F, APOBEC3G, and APOBEC3H Demonstrate a Conserved Capacity to Restrict Vif-Deficient HIV-1," *Journal of Virology*, 2011, vol. 85(21), pp. 11220-11234.

Munk, C., et al., "Functions, structure, and read-through alternative splicing of feline APOBEC3 genes," *Genome Biology*, 2008, vol. 9(3), Article R48, pp. 1-20.

Hayward, J., et al., "Differential Evolution of Antiretroviral Restriction Factors in Pteropid Bats as Revealed by APOBEC3 Gene Complexity," *Mol. Biol. Evol.*, 2018, vol. 35(7), pp. 1626-1637.

Henry, M., et al., "Evolution of the Primate APOBEC3A Cytidine Deaminase Gene and Identification of Related Coding Regions," *PLoS ONE*, 2012, vol. 7(1) pp. 1-7.

Yang, L, et al., "Engineering and optimizing deaminase fusions for genome editing," *Nature Communications*, 2016, 13330, 1-12.

Chylinski, K., et al., "Survey and Summary—Classification and evolution of type II CRISPR-Cas systems," *Nucleic Acids Research*, 2014, vol. 42(10), pp. 6091-6105.

* cited by examiner

POLYPEPTIDES USEFUL FOR GENE EDITING AND METHODS OF USE

CROSS-REFERENCE TO RELATED APPLICATIONS

This application is a national stage filing under 35 U.S.C. 371 of PCT/US2019/068079 filed Dec. 20, 2019, which was published by the International Bureau in English on Jul. 2, 2020, and which claims priority from U.S. Provisional Applications Nos. 62/785,391, filed Dec. 27, 2018, 62/790, 256, filed Jan. 9, 2019, 62/790,258, filed Jan. 9, 2019, 62/790,261, filed Jan. 9, 2019, 62/790,262, filed Jan. 9, 2019, 62/790,266, filed Jan. 9, 2019, and 62/932,169, filed Nov. 7, 2019, each of which is hereby incorporated in its entirety by reference in this application.

REFERENCE TO SEQUENCE LISTING SUBMITTED ELECTRONICALLY

The official copy of the sequence listing is submitted electronically via EFS-Web as an ASCII formatted sequence listing with a file named Seq_List.txt, created on Dec. 20, 2019, and having a size of 614,308 bytes, which is identical to the sequence listing submitted for International Application No. PCT/US2019/068079 on Dec. 20, 2019. The sequence listing contained in this ASCII formatted document is part of the specification and is herein incorporated by reference in its entirety.

FIELD OF THE INVENTION

The present invention relates to the field of molecular biology and gene editing.

BACKGROUND OF THE INVENTION

Targeted genome editing or modification is rapidly becoming an important tool for basic and applied research. Initial methods involved engineering nucleases such as meganucleases, zinc finger fusion proteins or TALENs, requiring the generation of chimeric nucleases with engineered, programmable, sequence-specific DNA-binding domains specific for each particular target sequence. RNA-guided nucleases (RGNs), such as the Clustered Regularly Interspaced Short Palindromic Repeats (CRISPR)-associated (cas) proteins of the CRISPR-cas bacterial system, allow for the targeting of specific sequences by complexing the nucleases with guide RNA that specifically hybridizes with a particular target sequence. Producing target-specific guide RNAs is less costly and more efficient than generating chimeric nucleases for each target sequence. Such RNA-guided nucleases can be used to edit genomes through the introduction of a sequence-specific, double-stranded break that is repaired via error-prone non-homologous end-joining (NHEJ) to introduce a mutation at a specific genomic location. Alternatively, heterologous DNA may be introduced into the genomic site via homology-directed repair.

Additionally, RGNs are useful for DNA editing approaches. Targeted editing of nucleic acid sequences, for example targeted cleavage to allow for introduction of a specific modification into genomic DNA, enables a highly nuanced approach to studying gene function and gene expression. Such targeted editing also may be deployed for targeting genetic diseases in humans or for introducing agronomically beneficial mutations in the genomes of crop plants. The development of genome editing tools provides new approaches to gene editing-based mammalian therapeutics and agrobiotechnology.

BRIEF SUMMARY OF THE INVENTION

Compositions and methods for binding a target nucleic acid sequence of interest are provided. The compositions find use in cleaving or modifying a target sequence of interest, detection of a target sequence of interest, and modifying the expression of a sequence of interest. Compositions comprise RNA-guided nuclease (RGN) polypeptides and variants thereof, CRISPR RNAs (crRNAs), trans-activating CRISPR RNAs (tracrRNAs), guide RNAs (gRNAs), deaminase polypeptides, nucleic acid molecules encoding the same, and vectors and host cells comprising the nucleic acid molecules. Also provided are CRISPR systems for binding a target sequence of interest, wherein the CRISPR system comprises an RNA-guided nuclease polypeptide and one or more guide RNAs. Also provided are fusion polypeptides comprising an RNA-guided, DNA binding polypeptide, and a deaminase polypeptide. Methods disclosed herein are drawn to binding a target nucleic acid sequence of interest, and in some embodiments, cleaving or modifying the target nucleic acid sequence of interest. The target sequence of interest can be modified, for example, as a result of non-homologous end joining or homology-directed repair with an introduced donor sequence, or as a result of base editing.

DETAILED DESCRIPTION

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended embodiments. Although specific terms are employed herein, they are used in a generic and descriptive sense only and not for purposes of limitation.

I. Overview

RNA-guided nucleases (RGNs) allow for the targeted manipulation of a single site within a genome and are useful in the context of gene targeting for therapeutic and research applications. In a variety of organisms, including mammals, RNA-guided nucleases have been used for genome engineering by stimulating non-homologous end joining and homologous recombination, for example. The compositions and methods described herein are useful for creating single- or double-stranded breaks in polynucleotides, modifying polynucleotides, detecting a particular site within a polynucleotide, or modifying the expression of a particular gene.

The RNA-guided nucleases disclosed herein can alter gene expression by modifying a target sequence. In specific embodiments, the RNA-guided nucleases are directed to the target sequence by a guide RNA (also referred to as gRNA or sgRNA) as part of a Clustered Regularly Interspaced Short Palindromic Repeats (CRISPR) RNA-guided nuclease system. Guide RNAs form a complex with the RNA-guided nucleases to direct the RNA-guided nuclease to bind to a target sequence and in some embodiments, introduce a single-stranded or double-stranded break at the target sequence. After the target sequence has been cleaved, the break can be repaired such that the DNA sequence of the target sequence is modified during the repair process. Thus, provided herein are methods for using the RNA-guided nucleases to modify a target sequence in the DNA of host cells. For example, RNA-guided nucleases can be used to modify a target sequence at a genomic locus of eukaryotic cells or prokaryotic cells.

This disclosure further provides deaminase polypeptides and nucleic acid molecules encoding the same, as well as fusion proteins that comprise a DNA-binding polypeptide and a deaminase polypeptide. In some embodiments, the DNA-binding polypeptide is or is derived from a mega-nuclease, zinc finger fusion protein, or TALEN. In some embodiments, the fusion protein comprises an RNA-guided DNA-binding polypeptide and a deaminase polypeptide. In some embodiments, the RNA-guided DNA-binding polypeptide is an RGN. In some embodiments, the RGN is a Type II CRISPR-Cas polypeptide. In other embodiments, the RGN is a Type V CRISPR-Cas polypeptide. In further embodiments, the RGN is a Cas9 polypeptide domain that binds to a gRNA, which, in turn, binds a target nucleic acid sequence via strand hybridization.

The deaminase polypeptide comprises a deaminase domain that can deaminate a nucleobase, such as, for example, cytidine. The deamination of a nucleobase by a deaminase can lead to a point mutation at the respective residue, which is referred to herein as "nucleic acid editing" or "base editing". Fusion proteins comprising an RGN polypeptide variant or domain and a deaminase domain can thus be used for the targeted editing of nucleic acid sequences.

Such fusion proteins are useful for targeted editing of DNA in vitro, e.g., for the generation of mutant cells. These mutant cells may be in plants or animals. Such fusion proteins may also be useful for the introduction of targeted mutations, e.g., for the correction of genetic defects in mammalian cells ex vivo, e.g., in cells obtained from a subject that are subsequently re-introduced into the same or another subject; and for the introduction of targeted mutations, e.g., the correction of genetic defects or the introduction of deactivating mutations in disease-associated genes in a mammalian subject. Such fusion proteins may also be useful for the introduction of targeted mutations in plant cells, e.g., for the introduction of beneficial or agronomically valuable traits or alleles.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof.

The term "fusion protein" as used herein refers to a hybrid polypeptide which comprises protein domains from at least two different proteins. One protein may be located at the amino-terminal (N-terminal) portion of the fusion protein or at the carboxyterminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a recombinase. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4th ed., Cold Spring Harbor Laboratory Press, Cold Spring Harbor, N.Y. (2012)), the entire contents of which are incorporated herein by reference.

II. RNA-Guided Nucleases

Provided herein are RNA-guided nucleases. The term RNA-guided nuclease (RGN) refers to a polypeptide that binds to a particular target nucleotide sequence in a sequence-specific manner and is directed to the target nucleotide sequence by a guide RNA molecule that is complexed with the polypeptide and hybridizes with the target sequence. Although an RNA-guided nuclease can be capable of cleaving the target sequence upon binding, the term RNA-guided nuclease also encompasses nuclease-dead RNA-guided nucleases that are capable of binding to, but not cleaving, a target sequence. Cleavage of a target sequence by an RNA-guided nuclease can result in a single- or double-stranded break. RNA-guided nucleases only capable of cleaving a single strand of a double-stranded nucleic acid molecule are referred to herein as nickases.

The RNA-guided nucleases disclosed herein include the APG00969, APG03128, APG09748, APG00771, and APG02789 RNA-guided nucleases, the amino acid sequences of which are set forth, respectively, as SEQ ID NOs: 1, 16, 24, 35, 43, or 50, and active fragments or variants thereof that retain the ability to bind to a target nucleotide sequence in an RNA-guided sequence-specific manner. In some of these embodiments, the active fragment or variant of the APG00969, APG03128, APG09748, APG00771, and APG02789 RGN is capable of cleaving a single- or double-stranded target sequence. In some embodiments, an active variant of the APG00969, APG03128, APG09748, APG00771, or APG02789 RGN comprises an amino acid sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence set forth as SEQ ID NOs: 1, 16, 24, 35, 43, or 50. In certain embodiments, an active fragment of the APG00969, APG03128, APG09748, APG00771, or APG02789 RGN comprises at least 50, 100, 150, 200, 250, 300, 350, 400, 450, 500, 550, 600, 650, 700, 750, 800, 850, 900, 950, 1000, 1050 or more contiguous amino acid residues of the amino acid sequence set forth as SEQ ID NOs:

1, 16, 24, 35, 43, or 50. RNA-guided nucleases provided herein can comprise at least one nuclease domain (e.g., DNase, RNase domain) and at least one RNA recognition and/or RNA binding domain to interact with guide RNAs. Further domains that can be found in RNA-guided nucleases provided herein include, but are not limited to: DNA binding domains, helicase domains, protein-protein interaction domains, and dimerization domains. In specific embodiments, the RNA-guided nucleases provided herein can comprise at least 70%, 75%, 80%, 85%, 90%, 91%, 92%, 93%, 94%, 95%, 96%, 97%, 98%, 99% to one or more of a DNA binding domains, helicase domains, protein-protein interaction domains, and dimerization domains.

A target nucleotide sequence is bound by an RNA-guided nuclease provided herein and hybridizes with the guide RNA associated with the RNA-guided nuclease. The target sequence can then be subsequently cleaved by the RNA-guided nuclease if the polypeptide possesses nuclease activity. The terms "cleave" or "cleavage" refer to the hydrolysis of at least one phosphodiester bond within the backbone of a target nucleotide sequence that can result in either single-stranded or double-stranded breaks within the target sequence. The presently disclosed RGNs can cleave nucleotides within a polynucleotide, functioning as an endonuclease or can be an exonuclease, removing successive nucleotides from the end (the 5' and/or the 3' end) of a polynucleotide. In other embodiments, the disclosed RGNs can cleave nucleotides of a target sequence within any position of a polynucleotide and thus function as both an endonuclease and exonuclease. The cleavage of a target polynucleotide by the presently disclosed RGNs can result in staggered breaks or blunt ends.

The presently disclosed RNA-guided nucleases can be wild-type sequences derived from bacterial or archaeal species. Alternatively, the RNA-guided nucleases can be variants or fragments of wild-type polypeptides. The wild-type RGN can be modified to alter nuclease activity or alter PAM specificity, for example. In some embodiments, the RNA-guided nuclease is not naturally-occurring.

In certain embodiments, the RNA-guided nuclease functions as a nickase, only cleaving a single strand of the target nucleotide sequence. Such RNA-guided nucleases have a single functioning nuclease domain. In some of these embodiments, additional nuclease domains have been mutated such that the nuclease activity is reduced or eliminated. The nuclease inactive RGN or nickase RGN may be referred to as an RNA-guided, DNA-binding polypeptide, or an RNA-guided, DNA-binding protein, or an RNA-guided, DNA-binding domain of a fusion protein.

In other embodiments, the RNA-guided nuclease lacks nuclease activity altogether or exhibits reduced nuclease activity, and is referred to herein as nuclease-dead. Any method known in the art for introducing mutations into an amino acid sequence, such as PCR-mediated mutagenesis and site-directed mutagenesis, can be used for generating nickases or nuclease-dead RGNs. See, e.g., U.S. Publ. No. 2014/0068797 and U.S. Pat. No. 9,790,490; each of which is incorporated by reference in its entirety.

RNA-guided nucleases that lack nuclease activity can be used to deliver a fused polypeptide, polynucleotide, or small molecule payload to a particular genomic location. In some of these embodiments, the RGN polypeptide or guide RNA can be fused to a detectable label to allow for detection of a particular sequence. As a non-limiting example, a nuclease-dead RGN can be fused to a detectable label (e.g., fluorescent protein) and targeted to a particular sequence associated with a disease to allow for detection of the disease-associated sequence.

Alternatively, nuclease-dead RGNs can be targeted to particular genomic locations to alter the expression of a desired sequence. In some embodiments, the binding of a nuclease-dead RNA-guided nuclease to a target sequence results in the repression of expression of the target sequence or a gene under transcriptional control by the target sequence by interfering with the binding of RNA polymerase or transcription factors within the targeted genomic region. In other embodiments, the RGN (e.g., a nuclease-dead RGN) or its complexed guide RNA further comprises an expression modulator that, upon binding to a target sequence, serves to either repress or activate the expression of the target sequence or a gene under transcriptional control by the target sequence. In some of these embodiments, the expression modulator modulates the expression of the target sequence or regulated gene through epigenetic mechanisms.

In other embodiments, the nuclease-dead RGNs or a RGN with only nickase activity can be targeted to particular genomic locations to modify the sequence of a target polynucleotide through fusion to a base-editing polypeptide, for example a deaminase polypeptide or active variant or fragment thereof that deaminates a nucleotide base, resulting in conversion from one nucleotide base to another. The base-editing polypeptide can be fused to the RGN at its N-terminal or C-terminal end. Additionally, the base-editing polypeptide may be fused to the RGN via a peptide linker. A non-limiting example of a deaminase polypeptide that is useful for such compositions and methods include cytidine deaminase or the adenosine deaminase base editor described in Gaudelli et al. (2017) *Nature* 551:464-471, U.S. Publ. Nos. 2017/0121693 and 2018/0073012, and International Publ. No. WO/2018/027078, each of which is herein incorporated by reference in its entirety.

RNA-guided nucleases that are fused to a polypeptide or domain can be separated or joined by a linker. The term "linker," as used herein, refers to a chemical group or a molecule linking two molecules or moieties, e.g., a binding domain and a cleavage domain of a nuclease. In some embodiments, a linker joins a gRNA binding domain of an RNA guided nuclease and a base-editing polypeptide, such as a deaminase. In some embodiments, a linker joins a nuclease-dead RGN and a deaminase. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The presently disclosed RNA-guided nucleases can comprise at least one nuclear localization signal (NLS) to enhance transport of the RGN to the nucleus of a cell. Nuclear localization signals are known in the art and generally comprise a stretch of basic amino acids (see, e.g., Lange et al., *J. Biol. Chem.* (2007) 282:5101-5105). In particular embodiments, the RGN comprises 2, 3, 4, 5, 6 or more nuclear localization signals. The nuclear localization signal(s) can be a heterologous NLS. Non-limiting examples of nuclear localization signals useful for the presently disclosed RGNs are the nuclear localization signals of SV40 Large T-antigen, nucleopasmin, and c-Myc (see, e.g., Ray et al. (2015) *Bioconjug Chem* 26(6):1004-7). In particular embodiments, the RGN comprises the NLS sequence set forth as SEQ ID NO: 10. The RGN can comprise one or more NLS sequences at its N-terminus, C-terminus, or both the N-terminus and C-terminus. For example, the RGN can comprise two NLS sequences at the N-terminal region and four NLS sequences at the C-terminal region.

Other localization signal sequences known in the art that localize polypeptides to particular subcellular location(s) can also be used to target the RGNs, including, but not limited to, plastid localization sequences, mitochondrial localization sequences, and dual-targeting signal sequences that target to both the plastid and mitochondria (see, e.g., Nassoury and Morse (2005) *Biochim Biophys Acta* 1743:5-19; Kunze and Berger (2015) *Front Physiol* dx.doi.org/10.3389/fphys.2015.00259; Hellmann and Neupert (2003) *IUBMB Life* 55:219-225; Soll (2002) *Curr Opin Plant Biol* 5:529-535; Carrie and Small (2013) *Biochim Biophys Acta* 1833:253-259; Carrie et al. (2009) *FEBS J* 276:1187-1195; Silva-Filho (2003) *Curr Opin Plant Biol* 6:589-595; Peeters and Small (2001) *Biochim Biophys Acta* 1541:54-63; Murcha et al. (2014) *J Exp Bot* 65:6301-6335; Mackenzie (2005) *Trends Cell Biol* 15:548-554; Glaser et al. (1998) *Plant Mol Biol* 38:311-338).

In certain embodiments, the presently disclosed RNA-guided nucleases comprise at least one cell-penetrating domain that facilitates cellular uptake of the RGN. Cell-penetrating domains are known in the art and generally comprise stretches of positively charged amino acid residues (i.e., polycationic cell-penetrating domains), alternating polar amino acid residues and non-polar amino acid residues (i.e., amphipathic cell-penetrating domains), or hydrophobic amino acid residues (i.e., hydrophobic cell-penetrating domains) (see, e.g., Milletti F. (2012) *Drug Discov Today* 17:850-860). A non-limiting example of a cell-penetrating domain is the trans-activating transcriptional activator (TAT) from the human immunodeficiency virus 1.

The nuclear localization signal, plastid localization signal, mitochondrial localization signal, dual-targeting localization signal, and/or cell-penetrating domain can be located at the amino-terminus (N-terminus), the carboxyl-terminus (C-terminus), or in an internal location of the RNA-guided nuclease.

The presently disclosed RGNs can be fused to an effector domain, such as a cleavage domain, a deaminase domain, or an expression modulator domain, either directly or indirectly via a linker peptide. Such a domain can be located at the N-terminus, the C-terminus, or an internal location of the RNA-guided nuclease. In some of these embodiments, the RGN component of the fusion protein is a nuclease-dead RGN.

In some embodiments, the RGN fusion protein comprises a cleavage domain, which is any domain that is capable of cleaving a polynucleotide (i.e., RNA, DNA, or RNA/DNA hybrid) and includes, but is not limited to, restriction endonucleases and homing endonucleases, such as Type IIS endonucleases (e.g., FokI) (see, e.g., Belfort et al. (1997) *Nucleic Acids Res.* 25:3379-3388; Linn et al. (eds.) Nucleases, Cold Spring Harbor Laboratory Press, 1993).

In other embodiments, the RGN fusion protein comprises a deaminase domain that deaminates a nucleotide base, resulting in conversion from one nucleotide base to another, and includes, but is not limited to, a cytidine deaminase or an adenosine deaminase base editor (see, e.g., Gaudelli et al. (2017) *Nature* 551:464-471, U.S. Publ. Nos. 2017/0121693 and 2018/0073012, U.S. Pat. No. 9,840,699, and International Publ. No. WO/2018/027078). In further embodiments, the RGN fusion protein may comprise a deaminase of the invention, which comprises the amino acid sequence of any one of SEQ ID NO: 374-545 or 572-584, or an active variant thereof.

In other embodiments, a deaminase of the invention, which comprises the amino acid sequence of any one of SEQ ID NO: 374-545 or 572-584, or an active variant thereof, may be fused to any DNA-binding protein. In some embodiments, the deaminase is fused to an RGN of the invention. In other embodiments, the deaminase is fused to an RGN known in the art. In other embodiments, the deaminase is fused to a DNA-binding protein that is not an RGN, such as for example a meganuclease, TALEN, or zinc finger nuclease. In some embodiments, the deaminase has an amino acid sequence of at least 50%, at least 55%, at least 60%, at least 65%, at least 70%, at least 75%, at least 80%, at least 85%, at least 90%, at least 95%, at least 96%, at least 97%, at least 98%, or at least 99% identity to the amino acid sequence of any of SEQ ID NOs: 374-545 and 572-584. In certain embodiments, the deaminase has an amino acid sequence of at least 50%, at least 55%, at least 60%, at least 65%, at least 70%, at least 75%, at least 80%, at least 85%, at least 90%, at least 95%, at least 96%, at least 97%, at least 98%, or at least 99% identity to the amino acid sequence of any of SEQ ID NOs: 374, 383, 397, 399, 407, 408, 411, 414, 416, 420, 514, and 572-584. In some of these embodiments, the variant deaminase polypeptide has a certain level of sequence identity to any one of SEQ ID NOs: 572-584, wherein specific amino acid residues are unchanged from the parent sequence. For example, in some embodiments, a variant SEQ ID NO: 572 comprises a lysine at a position corresponding to position 102, a tyrosine at a position corresponding to position 104, and a threonine at a position corresponding to position 106 of SEQ ID NO: 572. In particular embodiments, a variant SEQ ID NO: 574 comprises a glutamic acid at a position corresponding to position 101, a serine at a position corresponding to position 103, and a lysine at a position corresponding to position 105 of SEQ ID NO: 574. In certain embodiments, a variant SEQ ID NO: 575 comprises a lysine at a position corresponding to position 101, a leucine at a position corresponding to position 103, and a glutamic acid at a position corresponding to position 105 of SEQ ID NO: 575. In some embodiments, a variant SEQ ID NO: 576 comprises an alanine at a position corresponding to position 105 and an argnine at a position corresponding to position 107 of SEQ ID NO: 576. In particular embodiments, a variant SEQ ID NO: 577 comprises a glycine at a position corresponding to position 102, a serine at a position corresponding to position 104, and an arginine at a position corresponding to position 106 of SEQ ID NO: 577. In certain embodiments, a variant SEQ ID NO: 578 comprises a serine at a position corresponding to position 105 and a threonine at a position corresponding to position 107 of SEQ ID NO: 578. In some embodiments, a variant SEQ ID NO: 579 comprises a serine at a position corresponding to position 102, a glutamine at a position corresponding to position 104, and a glycine at a position corresponding to position 106 of SEQ ID NO: 579. In particular embodiments, a variant SEQ ID NO: 580 comprises a glycine at a position corresponding to position 111 of SEQ ID NO: 580. In some embodiments, a variant SEQ ID NO: 581 comprises a glutamine at a position corresponding to position 104, a glycine at a position corresponding to position 106, and a glutamic acid at a position corresponding to position 108 of SEQ ID NO: 581. In certain embodiments, a variant SEQ ID NO: 582 comprises an arginine at a position corresponding to position 102, a tryptophan at a position corresponding to position 104, and a glutamic acid at a position corresponding to position 106 of SEQ ID NO: 582. In certain embodiments, a variant SEQ ID NO: 583 comprises an arginine at a position corresponding to position 104 and a serine at a position corresponding to position 106 of SEQ ID NO: 583. In particular embodiments, a variant SEQ ID NO: 584 comprises a phenylalanine at a position corresponding to position 110, a serine at a position corresponding to position 112, and a threonine at a position corresponding to position 114 of SEQ ID NO: 584.

The term "deaminase" refers to an enzyme that catalyzes a deamination reaction (i.e., the removal of an amino group from an amino acid or other compound). In some embodiments, the deaminase is a cytidine deaminase, catalyzing the hydrolytic deamination of cytidine or deoxycytidine to uracil or deoxyuracil, respectively. In other embodiments, the deaminase is an adenine deaminase. Deamination of adenine yields inosine, which is treated as guanine by polymerases. Cytidine deaminases and adenine deaminases may work on either DNA or RNA, although to date there are no known naturally occurring adenine deaminases that deaminate adenine in DNA. Disclosed herein, however, is APG07458 (SEQ ID NO: 514) that is a naturally occurring protein with significant adenosine deaminase activity on DNA. The deaminases of the invention may be used for editing of DNA or RNA molecules. The deaminases of the invention, as a group, enable the programmable installation of all four transitions (C to T, A to G, T to C, and G to A) in DNA molecules and C to U, A to G, and G to A transitions in RNA molecules.

The deaminases of the invention operate on single-stranded nucleic acid molecules. An RGN which has nickase activity on the target strand nicks the target strand, while the complementary, non-target strand is modified by the deaminase. Cellular DNA-repair machinery may repair the nicked, target strand using the modified non-target strand as a template, thereby introducing a mutation in the DNA.

In some embodiments, a nuclease inactive RGN or nickase RGN fused to a deaminase can be targeted to particular genomic locations to alter the expression of a desired sequence. In some embodiments, the nuclease inactive RGN or nickase RGN may be referred to as an RNA-guided, DNA-binding polypeptide or protein or protein domain of a fusion protein. In some embodiments, the binding of this fusion protein to a target sequence results in deamination of a nucleotide base, resulting in conversion from one nucleotide base to another. In some embodiments, the effector domain of the RGN fusion protein can be an expression modulator domain, which is a domain that either serves to upregulate or downregulate transcription. The expression modulator domain can be an epigenetic modification domain, a transcriptional repressor domain or a transcriptional activation domain.

In some of these embodiments, the expression modulator of the RGN fusion protein comprises an epigenetic modification domain that covalently modifies DNA or histone proteins to alter histone structure and/or chromosomal structure without altering the DNA sequence, leading to changes in gene expression (i.e., upregulation or downregulation). Non-limiting examples of epigenetic modifications include acetylation or methylation of lysine residues, arginine methylation, serine and threonine phosphorylation, and lysine ubiquitination and sumoylation of histone proteins, and methylation and hydroxymethylation of cytosine residues in DNA. Non-limiting examples of epigenetic modification domains include histone acetyltransferase domains, histone deacetylase domains, histone methyltransferase domains, histone demethylase domains, DNA methyltransferase domains, and DNA demethylase domains.

In other embodiments, the expression modulator of the fusion protein comprises a transcriptional repressor domain, which interacts with transcriptional control elements and/or transcriptional regulatory proteins, such as RNA polymerases and transcription factors, to reduce or terminate transcription of at least one gene. Transcriptional repressor domains are known in the art and include, but are not limited to, Sp1-like repressors, IκB, and Krüppel associated box (KRAB) domains.

In yet other embodiments, the expression modulator of the fusion protein comprises a transcriptional activation domain, which interacts with transcriptional control elements and/or transcriptional regulatory proteins, such as RNA polymerases and transcription factors, to increase or activate transcription of at least one gene. Transcriptional activation domains are known in the art and include, but are not limited to, a herpes simplex virus VP16 activation domain and an NFAT activation domain.

The presently disclosed RGN and deaminase polypeptides, or fusion polypeptides thereof, can comprise a detectable label or a purification tag. The detectable label or purification tag can be located at the N-terminus, the C-terminus, or an internal location of the RNA-guided nuclease, either directly or indirectly via a linker peptide. In some of these embodiments, the RGN component of the fusion protein is a nuclease-dead RGN. In other embodiments, the RGN component of the fusion protein is an RGN with nickase activity.

A detectable label is a molecule that can be visualized or otherwise observed. The detectable label may be fused to the RGN as a fusion protein (e.g., fluorescent protein) or may be a small molecule conjugated to the RGN polypeptide that can be detected visually or by other means. Detectable labels that can be fused to the presently disclosed RGNs or deaminases as a fusion protein include any detectable protein domain, including but not limited to, a fluorescent protein or a protein domain that can be detected with a specific antibody. Non-limiting examples of fluorescent proteins include green fluorescent proteins (e.g., GFP, EGFP, ZsGreen1) and yellow fluorescent proteins (e.g., YFP, EYFP, ZsYellow1). Non-limiting examples of small molecule detectable labels include radioactive labels, such as $^3$H and $^{35}$S.

RGN and deaminase polypeptides of the invention, or fusion polypeptides thereof, can also comprise a purification tag, which is any molecule that can be utilized to isolate a protein or fused protein from a mixture (e.g., biological sample, culture medium). Non-limiting examples of purification tags include biotin, myc, maltose binding protein (MBP), and glutathione-S-transferase (GST).

II. Guide RNA

The present disclosure provides guide RNAs and polynucleotides encoding the same. The term "guide RNA" refers to a nucleotide sequence having sufficient complementarity with a target nucleotide sequence to hybridize with the target sequence and direct sequence-specific binding of an associated RNA-guided nuclease to the target nucleotide sequence. Thus, a RGN's respective guide RNA is one or more RNA molecules (generally, one or two), that can bind to the RGN and guide the RGN to bind to a particular target nucleotide sequence, and in those instances wherein the RGN has nickase or nuclease activity, also cleave the target nucleotide sequence. In general, a guide RNA comprises a CRISPR RNA (crRNA) and a trans-activating CRISPR RNA (tracrRNA). Native guide RNAs that comprise both a crRNA and a tracrRNA generally comprise two separate RNA molecules that hybridize to each other through the repeat sequence of the crRNA and the anti-repeat sequence of the tracrRNA.

Native direct repeat sequences within a CRISPR array generally range in length from 28 to 37 base pairs, although the length can vary between about 23 bp to about 55 bp. Spacer sequences within a CRISPR array generally range from about 32 to about 38 bp in length, although the length can be between about 21 bp to about 72 bp. Each CRISPR array generally comprises less than 50 units of the CRISPR repeat-spacer sequence. The CRISPRs are transcribed as part of a long transcript termed the primary CRISPR transcript, which comprises much of the CRISPR array. The primary CRISPR transcript is cleaved by Cas proteins to produce crRNAs or in some cases, to produce pre-crRNAs that are further processed by additional Cas proteins into mature crRNAs. Mature crRNAs comprise a spacer sequence and a CRISPR repeat sequence. In some embodiments in which pre-crRNAs are processed into mature (or processed) crRNAs, maturation involves the removal of about one to about six or more 5', 3', or 5' and 3' nucleotides. For the purposes of genome editing or targeting a particular target nucleotide sequence of interest, these nucleotides that are removed during maturation of the pre-crRNA molecule are not necessary for generating or designing a guide RNA.

A CRISPR RNA (crRNA) comprises a spacer sequence and a CRISPR repeat sequence. The "spacer sequence" is the nucleotide sequence that directly hybridizes with the target nucleotide sequence of interest. The spacer sequence is engineered to be fully or partially complementary with the target sequence of interest. In various embodiments, the spacer sequence can comprise from about 8 nucleotides to about 30 nucleotides, or more. For example, the spacer sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In some embodiments, the spacer sequence is about 10 to about 26 nucleotides in length, or about 12 to about 30 nucleotides in length. In particular embodiments, the spacer sequence is about 30 nucleotides in length. In some embodiments, the degree of complementarity between a spacer sequence and its corre-sponding target sequence, when optimally aligned using a suitable alignment algorithm, is about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the spacer sequence is free of secondary structure, which can be predicted using any suitable polynucleotide folding algorithm known in the art, including but not limited to mFold (see, e.g., Zuker and Stiegler (1981) *Nucleic Acids Res.* 9:133-148) and RNAfold (see, e.g., Gruber et al. (2008) *Cell* 106(1):23-24).

RGN proteins can have varying sensitivity to mismatches between a spacer sequence in a gRNA and its target sequence that affects the efficiency of cleavage.

The CRISPR RNA repeat sequence comprises a nucleo-tide sequence that comprises a region with sufficient complementarity to hybridize to a tracrRNA. In various embodiments, the CRISPR RNA repeat sequence can com-prise from about 8 nucleotides to about 30 nucleotides, or more. For example, the CRISPR repeat sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In some embodiments, the CRISPR repeat sequence is about 21 nucleotides in length. In some embodiments, the degree of complementarity between a CRISPR repeat sequence and its corresponding tracrRNA sequence, when optimally aligned using a suitable alignment algorithm, is about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more. In particular embodiments, the CRISPR repeat sequence comprises the nucleotide sequence of SEQ ID NOs: 2, 17, 25, 36, 44, 51, or 63, or an active variant or fragment thereof that when comprised within a guide RNA, is capable of directing the sequence-specific binding of an associated RNA-guided nuclease provided herein to a target sequence of interest. In certain embodiments, an active CRISPR repeat sequence variant of a wild-type sequence comprises a nucleotide sequence hav-ing at least 40%, 45%, 50%, 55%, 60%, 65%, 70%, 75%, 80%, 85%, 90%, 91%, 92%, 93%, 94%, 95%, 96%, 97%, 98%, 99% or more sequence identity to the nucleotide sequence set forth as SEQ ID NOs: 2, 17, 25, 36, 44, 51, or 63. In certain embodiments, an active CRISPR repeat sequence fragment of a wild-type sequence comprises at least 5, 6, 7, 8, 9, 10, 11, 12, 13, 14, 15, 16, 17, 18, 19, or 20 contiguous nucleotides of the nucleotide sequence set forth as SEQ ID NOs: 2, 17, 25, 36, 44, or 51.

In certain embodiments, the crRNA is not naturally-occurring. In some of these embodiments, the specific CRISPR repeat sequence is not linked to the engineered spacer sequence in nature and the CRISPR repeat sequence is considered heterologous to the spacer sequence. In certain embodiments, the spacer sequence is an engineered sequence that is not naturally occurring.

A trans-activating CRISPR RNA or tracrRNA molecule comprises a nucleotide sequence comprising a region that has sufficient complementarity to hybridize to a CRISPR repeat sequence of a crRNA, which is referred to herein as the anti-repeat region. In some embodiments, the tracrRNA molecule further comprises a region with secondary struc-ture (e.g., stem-loop) or forms secondary structure upon hybridizing with its corresponding crRNA. In particular embodiments, the region of the tracrRNA that is fully or partially complementary to a CRISPR repeat sequence is at the 5' end of the molecule and the 3' end of the tracrRNA comprises secondary structure. For Type II RGNs, this region of secondary structure generally comprises several hairpin structures, including the nexus hairpin, which is found adjacent to the anti-repeat sequence. The nexus hair-pin often has a conserved nucleotide sequence in the base of the hairpin stem, with the motif UNANNC (SEQ ID NO: 13; for APG00969), ANGNNU (SEQ ID NO: 23; for APG03128), or UNANNA (SEQ ID NO: 42; for APG00771) found in the nexus hairpins of tracrRNAs. There are often terminal hairpins at the 3' end of the tracrRNA that can vary in structure and number, but often comprise a GC-rich Rho-independent transcriptional termi-nator hairpin followed by a string of U's at the 3' end. See, for example, Briner et al. (2014) *Molecular Cell* 56:333-

339, Briner and Barrangou (2016) *Cold Spring Harb Protoc*; doi: 10.1101/pdb.top090902, and U.S. Publication No. 2017/0275648, each of which is herein incorporated by reference in its entirety.

In various embodiments, the anti-repeat region of the tracrRNA that is fully or partially complementary to the CRISPR repeat sequence comprises from about 8 nucleotides to about 30 nucleotides, or more. For example, the region of base pairing between the tracrRNA anti-repeat sequence and the CRISPR repeat sequence can be about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, or more nucleotides in length. In particular embodiments, the anti-repeat region of the tracrRNA that is fully or partially complementary to a CRISPR repeat sequence is about 20 nucleotides in length. In some embodiments, the degree of complementarity between a CRISPR repeat sequence and its corresponding tracrRNA anti-repeat sequence, when optimally aligned using a suitable alignment algorithm, is about or more than about 50%, about 60%, about 70%, about 75%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or more.

In various embodiments, the entire tracrRNA can comprise from about 60 nucleotides to more than about 140 nucleotides. For example, the tracrRNA can be about 60, about 65, about 70, about 75, about 80, about 85, about 90, about 95, about 100, about 105, about 110, about 115, about 120, about 125, about 130, about 135, about 140, or more nucleotides in length. In particular embodiments, the tracrRNA is about 80 to about 90 nucleotides in length, including about 80, about 81, about 82, about 83, about 84, about 85, about 86, about 87, about 88, about 89, and about 90 nucleotides in length. In certain embodiments, the tracrRNA is about 85 nucleotides in length.

In particular embodiments, the tracrRNA comprises the nucleotide sequence of SEQ ID NOs: 3, 18, 26, 37, 45, 52, or 62, or an active variant or fragment thereof that when comprised within a guide RNA is capable of directing the sequence-specific binding of an associated RNA-guided nuclease provided herein to a target sequence of interest. In certain embodiments, an active tracrRNA sequence variant of a wild-type sequence comprises a nucleotide sequence having at least 40%, 45%, 50%, 55%, 60%, 65%, 70%, 75%, 80%, 85%, 90%, 91%, 92%, 93%, 94%, 95%, 96%, 97%, 98%, 99% or more sequence identity to the nucleotide sequence set forth as SEQ ID NOs: 3, 18, 26, 37, 45, 52, or 62. In certain embodiments, an active tracrRNA sequence fragment of a wild-type sequence comprises at least 5, 10, 15, 20, 25, 30, 35, 40, 45, 50, 55, 60, 65, 70, 75, 80, or more contiguous nucleotides of the nucleotide sequence set forth as SEQ ID NOs: 3, 18, 26, 37, 45, or 52.

Two polynucleotide sequences can be considered to be substantially complementary when the two sequences hybridize to each other under stringent conditions. Likewise, an RGN is considered to bind to a particular target sequence within a sequence-specific manner if the guide RNA bound to the RGN binds to the target sequence under stringent conditions. By "stringent conditions" or "stringent hybridization conditions" is intended conditions under which the two polynucleotide sequences will hybridize to each other to a detectably greater degree than to other sequences (e.g., at least 2-fold over background). Stringent conditions are sequence-dependent and will be different in different circumstances. Typically, stringent conditions will be those in which the salt concentration is less than about 1.5 M Na ion, typically about 0.01 to 1.0 M Na ion concentration (or other salts) at pH 7.0 to 8.3, and the temperature is at least about 30° C. for short sequences (e.g., 10 to 50 nucleotides) and at least about 60° C. for long sequences (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The Tm is the temperature (under defined ionic strength and pH) at which 50% of a complementary target sequence hybridizes to a perfectly matched sequence. For DNA-DNA hybrids, the Tm can be approximated from the equation of Meinkoth and Wahl (1984) Anal. Biochem. 138:267-284: $Tm=81.5° C.+16.6 (log M)+0.41 (\% GC)-0.61 (\% form)-500/L$; where M is the molarity of monovalent cations, % GC is the percentage of guanosine and cytosine nucleotides in the DNA, % form is the percentage of formamide in the hybridization solution, and L is the length of the hybrid in base pairs. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3, or 4° C. lower than the thermal melting point (Tm); moderately stringent conditions can utilize a hybridization and/or wash at 6, 7, 8, 9, or 10° C. lower than the thermal melting point (Tm); low stringency conditions can utilize a hybridization and/or wash at 11, 12, 13, 14, 15, or 20° C. lower than the thermal melting point (Tm). Using the equation, hybridization and wash compositions, and desired Tm, those of ordinary skill will understand that variations in the stringency of hybridization and/or wash solutions are inherently described. An extensive guide to the hybridization of nucleic acids is found in Tijssen (1993) Laboratory Techniques in Biochemistry and Molecular Biology—Hybridization with Nucleic Acid Probes, Part I, Chapter 2 (Elsevier, New York); and Ausubel et al., eds. (1995) Current Protocols in Molecular Biology, Chapter 2 (Greene Publishing and Wiley-Interscience, New York). See Sambrook et al. (1989) Molecular Cloning: A Laboratory Manual (2d ed., Cold Spring Harbor Laboratory Press, Plainview, N.Y.).

The guide RNA can be a single guide RNA or a dual-guide RNA system. A single guide RNA comprises the crRNA and tracrRNA on a single molecule of RNA, whereas a dual-guide RNA system comprises a crRNA and a tracrRNA present on two distinct RNA molecules, hybridized to one another through at least a portion of the CRISPR repeat sequence of the crRNA and at least a portion of the tracrRNA, which may be fully or partially complementary to the CRISPR repeat sequence of the crRNA. In some of those embodiments wherein the guide RNA is a single guide RNA, the crRNA and tracrRNA are separated by a linker nucleotide sequence. In general, the linker nucleotide sequence is one that does not include complementary bases in order to avoid the formation of secondary structure within or comprising nucleotides of the linker nucleotide sequence. In some embodiments, the linker nucleotide sequence between the crRNA and tracrRNA is at least 3, at least 4, at least 5, at least 6, at least 7, at least 8, at least 9, at least 10, at least 11, at least 12, or more nucleotides in length. In particular embodiments, the linker nucleotide sequence of a single guide RNA is at least 4 nucleotides in length. In certain embodiments, the linker nucleotide sequence is the nucleotide sequence set forth as SEQ ID NO: 8 or 31. In other embodiments, the linker nucleotide sequence is at least 6 nucleotides in length.

The single guide RNA or dual-guide RNA can be synthesized chemically or via in vitro transcription. Assays for determining sequence-specific binding between a RGN and a guide RNA are known in the art and include, but are not limited to, in vitro binding assays between an expressed RGN and the guide RNA, which can be tagged with a detectable label (e.g., biotin) and used in a pull-down detection assay in which the guide RNA:RGN complex is captured via the detectable label (e.g., with streptavidin beads). A control guide RNA with an unrelated sequence or structure to the guide RNA can be used as a negative control for non-specific binding of the RGN to RNA. In certain embodiments, the guide RNA is SEQ ID NO: 4, 19, 27, 38, 46, 53, 64, 65, or 66, wherein the spacer sequence can be any sequence and is indicated as a poly-N sequence.

In certain embodiments, the guide RNA can be introduced into a target cell, organelle, or embryo as an RNA molecule. The guide RNA can be transcribed in vitro or chemically synthesized. In other embodiments, a nucleotide sequence encoding the guide RNA is introduced into the cell, organelle, or embryo. In some of these embodiments, the nucleotide sequence encoding the guide RNA is operably linked to a promoter (e.g., an RNA polymerase III promoter). The promoter can be a native promoter or heterologous to the guide RNA-encoding nucleotide sequence.

In various embodiments, the guide RNA can be introduced into a target cell, organelle, or embryo as a ribonucleoprotein complex, as described herein, wherein the guide RNA is bound to an RNA-guided nuclease polypeptide.

The guide RNA directs an associated RNA-guided nuclease to a particular target nucleotide sequence of interest through hybridization of the guide RNA to the target nucleotide sequence. A target nucleotide sequence can comprise DNA, RNA, or a combination of both and can be single-stranded or double-stranded. A target nucleotide sequence can be genomic DNA (i.e., chromosomal DNA), plasmid DNA, or an RNA molecule (e.g., messenger RNA, ribosomal RNA, transfer RNA, micro RNA, small interfering RNA). The target nucleotide sequence can be bound (and in some embodiments, cleaved) by an RNA-guided nuclease in vitro or in a cell. The chromosomal sequence targeted by the RGN can be a nuclear, plastid or mitochondrial chromosomal sequence. In some embodiments, the target nucleotide sequence is unique in the target genome.

The target nucleotide sequence is adjacent to a protospacer adjacent motif (PAM). A protospacer adjacent motif is generally within about 1 to about 10 nucleotides from the target nucleotide sequence, including about 1, about 2, about 3, about 4, about 5, about 6, about 7, about 8, about 9, or about 10 nucleotides from the target nucleotide sequence. The PAM can be 5' or 3' of the target sequence. In some embodiments, the PAM is 3' of the target sequence for the presently disclosed RGNs. Generally, the PAM is a consensus sequence of about 3-4 nucleotides, but in particular embodiments, can be 2, 3, 4, 5, 6, 7, 8, 9, or more nucleotides in length. In various embodiments, the PAM sequence recognized by the presently disclosed RGNs comprises the consensus sequence set forth as SEQ ID NOs: 7, 22, 30, 41, or 49.

In particular embodiments, an RNA-guided nuclease having SEQ ID NOs: 1, 16, 24, 35, 43, or 50 or an active variant or fragment thereof binds respectively a target nucleotide sequence adjacent to a PAM sequence set forth as SEQ ID NOs: 7, 22, 30, 41, or 49. In some of these embodiments, the RGN binds to a guide sequence comprising a CRISPR repeat sequence set forth in SEQ ID NOs: 2, 17, 25, 36, 44, 51, or 63, respectively, or an active variant or fragment thereof, and a tracrRNA sequence set forth in SEQ ID NOs: 3, 18, 26, 37, 45, 52, or 62, respectively, or an active variant or fragment thereof. The RGN systems are described further in Example 1 and Table 1 of the present specification.

It is well-known in the art that PAM sequence specificity for a given nuclease enzyme is affected by enzyme concentration (see, e.g., Karvelis et al. (2015) *Genome Biol* 16:253), which may be modified by altering the promoter used to express the RGN, or the amount of ribonucleoprotein complex delivered to the cell, organelle, or embryo.

Upon recognizing its corresponding PAM sequence, the RGN can cleave the target nucleotide sequence at a specific cleavage site. As used herein, a cleavage site is made up of the two particular nucleotides within a target nucleotide sequence between which the nucleotide sequence is cleaved by an RGN. The cleavage site can comprise the $1^{st}$ and $2^{nd}$, $2^{nd}$ and $3^{rd}$, $3^{rd}$ and $4^{th}$, $4^{th}$ and $5^{th}$, $5^{th}$ and $6^{th}$, $7^{th}$ and $8^{th}$, or $8^{th}$ and $9^{th}$ nucleotides from the PAM in either the 5' or 3' direction. In some embodiments, the cleavage site may be over 10, 11, 12, 13, 14, 15, 16, 17, 18, 19, or 20 nucleotides from the PAM in either the 5' or 3' direction. In some embodiments, the cleavage site is 4 nucleotides away from the PAM. In other embodiments, the cleavage site is at least 15 nucleotides away from the PAM. As RGNs can cleave a target nucleotide sequence resulting in staggered ends, in some embodiments, the cleavage site is defined based on the distance of the two nucleotides from the PAM on the positive (+) strand of the polynucleotide and the distance of the two nucleotides from the PAM on the negative (−) strand of the polynucleotide.

III. Fusion Proteins

The term "linker," as used herein, refers to a chemical group or a molecule linking two molecules or moieties, e.g., a binding domain and a cleavage domain of a nuclease. In some embodiments, a linker joins an RNA guided nuclease and a deaminase. In some embodiments, a linker joins a dCas9 and a deaminase. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

Some aspects of this disclosure provide fusion proteins that comprise a DNA-binding polypeptide and a deaminase polypeptide. The DNA-binding polypeptide may be any protein or protein domain which binds to DNA. In some embodiments, the DNA-binding polypeptide of the fusion protein is a meganuclease, zinc finger fusion protein, or TALEN. Some aspects of this disclosure provide fusion proteins that comprise an RNA-guided DNA-binding polypeptide and a deaminase polypeptide. In some embodiments, the RNA-guided DNA-binding polypeptide is an RNA-guided nuclease. In some embodiments, the RNA-guided nuclease is an RGN of the invention. In some embodiments, the RGN is not an RGN of the invention. In further embodiments, the RNA-guided nuclease is a CRISPR-Cas protein. In still further embodiments, the CRISPR-Cas protein is a Type II CRISPR-Cas protein. In other embodiments, the CRISPR-Cas protein is a Type V CRISPR-Cas protein. In other embodiments, the CRISPR-Cas protein is a Type VI CRISPR-Cas protein. In some embodiments, the RNA-guided nuclease is a Cas9 domain that binds to a guide RNA, which, in turn, binds a target nucleic acid sequence via strand hybridization. In some embodiments, the deaminase polypeptide may be a deaminase domain that can deaminate a nucleobase, such as, for example, cytidine or adenine. In some embodiments, the deaminase polypeptide comprises an amino acid sequence selected from any of SEQ ID NO: 374-545 or 572-584, or a variant thereof. In some of these embodiments, the deaminase polypeptide comprises an amino acid sequence selected from any one of SEQ ID NOs: 374, 383, 397, 399, 407, 408, 411, 414, 416, 420, 514, and 572-584, or a variant thereof. The deamination of a nucleobase by a deaminase can lead to a point mutation at the respective residue, thereby modifying the DNA molecule. This act of modification is also referred to herein as nucleic acid editing, or base editing. Fusion proteins comprising a Cas9 variant or domain and a deaminase domain can thus be used for the targeted editing of nucleic acid sequences.

Such fusion proteins are useful for targeted editing of DNA in vitro, e.g., for the generation of mutant cells. These mutant cells may be in plants or animals. Such fusion proteins may also be useful for the introduction of targeted mutations, e.g., for the correction of genetic defects in mammalian cells ex vivo, e.g., in cells obtained from a subject that are subsequently re-introduced into the same or another subject; and for the introduction of targeted mutations, e.g., the correction of genetic defects or the introduction of deactivating mutations in disease-associated genes in a mammalian subject. Such fusion proteins may also be useful for the introduction of targeted mutations in plant cells, e.g., for the introduction of beneficial or agronomically important traits or alleles.

The term "uracil glycosylase inhibitor" or "UGI," as used herein, refers to a protein that is capable of inhibiting an uracil-DNA glycosylase base-excision repair enzyme. In some embodiments, the fusion protein comprises a nuclease-inactive RGN, such as Cas9 (dCas9) fused to a deaminase. In some embodiments, the fusion protein comprises a nickase RGN, such as Cas9 (nCas9), fused to a deaminase. In some embodiments, the fusion protein comprises a nuclease inactive RGN or a nickase RGN fused to a deaminase and further fused to a UGI domain.

In some embodiments, the nickase RGN of the fusion protein comprises a D10A mutation or a homologously equivalent mutation (SEQ ID NO: 569; or similarly SEQ ID NO: 553) which renders the RGN capable of cleaving only the target strand (the strand which comprises the PAM) of a nucleic acid duplex. In some embodiments, the nuclease-inactive ("dead") RGN of the fusion protein comprises a D10A mutation and a H840A mutation or homologously equivalent mutations (SEQ ID NO: 568; or similarly SEQ ID NO: 547), which renders the RGN incapable to cleave the DNA target. In some embodiments, the nickase RGN of the fusion protein comprises a H840A mutation, which renders the RGN capable of cleaving only the non-target strand (the strand which does not comprise the PAM) of a nucleic acid duplex. A nickase RGN comprising an H840A mutation, or an equivalent mutation, has an inactivated HNH domain. A nickase RGN comprising a D10A mutation, or an equivalent mutation, has an inactivated RuvC domain. The deaminase acts on the non-target strand. A nickase comprising a D10A mutation, or an equivalent mutation, has an inactive RuvC nuclease domain and is not able to cleave the non-targeted strand of the DNA, i.e., the strand where base editing is desired.

In some embodiments, the RGN of the fusion proteins described herein have nickase activity, wherein the nickase may be a fragment of an RGN or a nickase variant of an RGN. In some embodiments, the RGN domain of the fusion proteins described herein have at least partially deactivated nuclease activity, and may be referred to as RNA-guided, DNA-binding polypeptides. Methods for the use of said fusion proteins as described herein are also provided. In some embodiments, the RGN is a Cas9 protein. Non-limiting, exemplary nuclease-inactive and nickase Cas9 domains are provided herein. One exemplary suitable nuclease-inactive RGN domains is the D10A/H840A Cas9 domain mutant (see, e.g., Qi et al., Cell. 2013; 152(5): 1173-83, the entire contents of which are incorporated herein by reference). Additional suitable nuclease-inactive Cas9 domains will be apparent to those of skill in the art based on this disclosure. Such additional exemplary suitable nuclease inactive Cas9 domains include, but are not limited to, D10A, D10A/D839A/H840A, and D10A/D839A/H840A/N863A mutant domains (See, e.g., Mali et al., Nature Biotechnology. 2013; 31(9): 833-838, the entire contents of which are incorporated herein by reference). Additionally, suitable nuclease-inactive RGN domains of other known RGNs can be determined (for example, SEQ ID NO: 547, a nuclease-inactive variant of the RGN APG08290.1; see U.S. patent application Ser. No. 16/432, 321, the entire contents of which are incorporated herein by reference herein).

Some aspects of this disclosure provide fusion proteins comprising (i) a nuclease-inactive or nickase RGN or domain; and (ii) a deaminase enzyme or domain. In some embodiments, the deaminase enzyme or domain is a DNA-editing enzyme or domain. In some embodiments, the deaminase enzyme possesses deaminase activity. In some embodiments, the deaminase enzyme or domain comprises or is a deaminase domain. In some embodiments, the deaminase is a cytidine deaminase. In some embodiments, the deaminase is an apolipoprotein B mRNA-editing complex (APOBEC) family deaminase. In some embodiments, the deaminase is an APOBEC1 family deaminase. In other embodiments, the deaminase is an APOBEC3 family deaminase. In some embodiments, the deaminase is an activation-induced cytidine deaminase (AID). In some embodiments, the deaminase is an ACF1/ASE deaminase. In some embodiments, the deaminase is an adenosine deaminase. In some embodiments, the deaminase is an ADAT family deaminase. Some nucleic-acid deaminase enzymes and domains are described in detail herein (see Table 17). Additional suitable deaminase enzymes or domains will be apparent to the skilled artisan based on this disclosure. In some of these embodiments, the deaminase polypeptide comprises an amino acid sequence selected from any one of SEQ ID NOs:

374, 383, 397, 399, 407, 408, 411, 414, 416, 420, 514, and 572-584, or a variant thereof.

The instant disclosure provides fusion proteins of various configurations. In some embodiments, the deaminase enzyme or domain is fused to the N-terminus of the RGN domain. In some embodiments, the deaminase enzyme or domain is fused to the C-terminus of the RGN domain. In some embodiments, the linker comprises a $(GGGGS)_n$ (SEQ ID NO: 585), a $(G)_n$ (SEQ ID NO: 586), an $(EAAAK)_n$ (SEQ ID NO: 587), or an $(XP)_n$ (SEQ ID NO: 588) motif, or a combination of any of these, wherein n is independently an integer between 1 and 30. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. Additional suitable linker motifs and linker configurations will be apparent to those of skill in the art. In some embodiments, suitable linker motifs and configurations include those described in Chen et al., Fusion protein linkers: property, design and functionality (*Adv Drug Deliv Rev.* 2013; 65(10):1357-69, the entire contents of which are incorporated herein by reference). Additional suitable linker sequences will be apparent to those of skill in the art based on the instant disclosure.

In some embodiments, the general architecture of exemplary fusion proteins provided herein comprises the structure: $[NH_2]$-[deaminase enzyme or domain]-[RGN protein or domain][COOH] or $[NH_2]$-[RGN protein or domain]-[deaminase enzyme or domain][COOH], wherein $NH_2$ is the N-terminus of the fusion protein, and COOH is the C-terminus of the fusion protein. Additional features may be present, for example, one or more linker sequences between the NLS and the rest of the fusion protein and/or between the deaminase enzyme or domain and the RGN protein or domain. Other exemplary features that may be present are localization sequences, such as nuclear localization sequences, cytoplasmic localization sequences, export sequences, such as nuclear export sequences, or other localization sequences, as well as sequence tags that are useful for solubilization, purification or detection of the fusion proteins. Suitable localization signal sequences and sequences of protein tags that are provided herein, and include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), streptags, biotin ligase tags, FlAsH tags, V5 tags, and SBP-tags. Additional suitable sequences will be apparent to those of skill in the art.

In some embodiments, the deaminase enzyme or the general architecture of exemplary fusion proteins with a deaminase enzyme or domain comprises the structure: $[NH_2]$-[NLS]-[RGN protein or domain]-[deaminase]-[COOH], $[NH_2]$-[NLS]-[deaminase]-[RGN protein or domain]-[COOH], $[NH_2]$-[RGN protein or domain]-[deaminase]-[COOH], or $[NH_2]$-[deaminase]-[RGN protein or domain]-[COOH] wherein NLS is a nuclear localization signal, $NH_2$ is the N-terminus of the fusion protein, and COOH is the C-terminus of the fusion protein. In some embodiments, a linker is inserted between the RGN protein or domain and the deaminase. In some embodiments, the NLS is located C-terminal of the deaminase and/or the RGN protein or domain. In some embodiments, the NLS is located between the deaminase and the RGN protein or domain.

Additional features, such as sequence tags, may also be present. "RGN protein or domain" here represents any RNA-guided nuclease, including CRISPR-Cas proteins and variants and mutants thereof, which can be used to create a fusion protein of the invention. The RGN protein may be a nuclease-inactive RGN or CRISPR-Cas, such as for example dCas9 (SEQ ID NO: 568) or alternatively SEQ ID NO: 547, or a RGN or Cas9 nickase, such as for example SEQ ID NO: 569 (or SEQ ID NO: 553). In some embodiments, a fusion protein of the invention comprises a RNA-guided, DNA-binding polypeptide and a deaminase, wherein the deaminase has an amino acid sequence of at least 50%, at least 55%, at least 60%, at least 65%, at least 70%, at least 75%, at least 80%, at least 85%, at least 90%, at least 95%, at least 96%, at least 97%, at least 98%, at least 99%, or 100% identical to any of SEQ ID NO: 374-545 or 572-584, or an active variant thereof. In some of these embodiments, the fusion protein comprises a deaminase polypeptide comprising an amino acid sequence selected from any one of SEQ ID NOs: 374, 383, 397, 399, 407, 408, 411, 414, 416, 420, 514, and 572-584, or a variant thereof. Examples of such fusion proteins are described in the Examples section here.

One exemplary suitable type of deaminase enzymes and domains are cytosine deaminases, for example, of the APOBEC family. The apolipoprotein B mRNA editing complex (APOBEC) family of cytosine deaminase enzymes encompasses eleven proteins that serve to initiate mutagenesis in a controlled and beneficial manner (Conticello et al., 2008. Genome Biology, 9(6): 229). One family member, activation-induced cytidine deaminase (AID), is responsible for the maturation of antibodies by converting cytosines in ssDNA to uracils in a transcription dependent, strand-biased fashion (Reynaud et al., 2003. Nature Immunology, 4(7): 631-638). The apolipoprotein B editing complex 3 (APOBEC3) enzyme provides protection to human cells against a certain HIV-1 strain via the deamination of cytosines in reverse-transcribed viral ssDNA (Bhagwat et al., 2004, 3(1): 85-9). These proteins all require a $Zn^{2+}$-coordinating motif $(HisX-Glu-X_{23-26}-Pro-Cys-X_{2-4}-Cys$; SEQ ID NO: 589) and bound water molecule for catalytic activity. The Glu residue acts to activate the water molecule to a zinc hydroxide for nucleophilic attack in the deamination reaction. Each family member preferentially deaminates at its own particular "hotspot", ranging from WRC (Wis A or T, R is A or G) for hAID, to TTC for hAPOBEC3F (Navaratnam et al., 2006. Intl J Hematol 83(3): 195-200). A recent crystal structure of the catalytic domain of APOBEC3G revealed a secondary structure comprised of a five-stranded β-sheet core flanked by six α-helices, which is believed to be conserved across the entire family (Holden et al., 2008. Nature 456(7218): 121-124). The active center loops have been shown to be responsible for both ssDNA binding and in determining "hotspot" identity (Chelico et al., 2009. J Biol Chem 284(41): 27761-27765). Overexpression of these enzymes has been linked to genomic instability and cancer, thus highlighting the importance of sequence-specific targeting (Pham et al., 2005. Biochem 44(8): 2703-2715).

Another exemplary suitable type of deaminase enzymes and domains are adenosine deaminases. An ADAT family adenosine deaminase can be fused to an RGN or fragment or a domain of an RGN or a variant thereof, such as for example a nuclease-inactive Cas9 domain, thus yielding a Cas9-ADAT fusion protein. This disclosure includes a systematic series of fusions between an RGN or fragment or a domain of an RGN or a variant thereof and a deaminase enzyme, for example a cytosine deaminase such as an APOBEC enzyme, or an adenosine deaminase enzyme such as an ADAT enzyme, so that the RGN-deaminase fusion directs the enzymatic activity of the deaminase to a specific site in genomic DNA. The advantages of using an RGN as the recognition agent are twofold: (1) the sequence specificity of the fusion protein can be easily altered by simply changing the sgRNA sequence; and (2) RGNs such as Cas9 bind to its target sequence by denaturing the dsDNA, resulting in a stretch of DNA that is single-stranded and therefore a viable substrate for the deaminase. Successful fusion proteins have been generated with human and mouse deaminase domains, e.g., AID domains (WO 2010132092, incorporated by reference herein). A variety of other fusion proteins between deaminases recited herein and an RGN are also contemplated.

The portion of DNA that is single stranded in the RGN-DNA complex (the size of the RGN-DNA bubble) has not been delineated. However, it has been shown in a dCas9 system with a sgRNA specifically designed for the complex to interfere with transcription that transcriptional interference only occurs when the sgRNA binds to the non-template strand. This result suggests that certain portions of the DNA in the DNA-Cas9 complex are unguarded by Cas9 and could potentially be targeted by a deaminase in the fusion protein (Qi et al., 2013. Cell 152(15): 1173-83). Accordingly, both N-terminal and C-terminal fusions of Cas9, or generically an RGN, with a deaminase domain are useful according to aspects of this disclosure.

In some embodiments, the deaminase domain and the RNA-guided, DNA-binding domain of an RGN are fused to each other via a linker. Various linker lengths and flexibilities between the deaminase domain (e.g., AID) and the RGN domain can be employed (e.g., ranging from very flexible linkers of the form $(GGGGS)_n$ (SEQ ID NO 590) and $(G)_n$ to more rigid linkers of the form $(EAAAK)_n$ (SEQ ID NO: 591) and $(XP)_n$ in order to achieve the optimal length for deaminase activity for the specific applications.

Some exemplary suitable nucleic-acid editing enzymes and domains, e.g., deaminases and deaminase domains, that can be fused to RNA-guided, DNA-binding domains according to aspects of this disclosure are provided (SEQ ID NOs: 374-545 and 572-584). It will be understood that, in some embodiments, the active domain of the respective sequence can be used, e.g., the domain without a localizing signal (nuclear localizing signal, without nuclear export signal, cytoplasmic localizing signal).

In some embodiments, fusion proteins as provided herein comprise the full-length amino acid of a deaminase enzyme, e.g., any one of SEQ ID NO: 374-545 or 572-584. In other embodiments, however, fusion proteins as provided herein do not comprise a full-length sequence of a nucleic acid editing enzyme, but only a fragment thereof. For example, in some embodiments, a fusion protein provided herein comprises an RNA-guided, DNA-binding domain and a fragment of a deaminase enzyme, e.g., wherein the fragment comprises a deaminase domain. Exemplary amino acid sequences of deaminase domains are described in Table 17, and additional suitable sequences of such domains will be apparent to those of skill in the art.

Additional suitable nucleic-acid editing enzyme sequences, e.g., deaminase enzyme and domain sequences, that can be used according to aspects of this invention, e.g., that can be fused to a nuclease-inactive or nickase RGN domain, will be apparent to those of skill in the art based on this disclosure. In some embodiments, such additional enzyme sequences include deaminase enzyme or deaminase domain sequences that are at least 70%, at least 75%, at least 80%, at least 85%, at least 90%, at least 95%, at least 96%, at least 97%, at least 98%, or at least 99% similar to the sequences provided herein. Additional suitable RGN domains, variants, and sequences will also be apparent to those of skill in the art. Examples of such additional suitable RGN domains include, but are not limited to, D10A, D10A/ D839A/H840A, and D10A/D839A/H840A/N863A mutant domains (See, e.g., Mali et al., Cas9 transcriptional activators for target specificity screening and paired nickases for cooperative genome engineering. *Nature Biotechnology*. 2013; 31(9): 833-838 the entire contents of which are incorporated herein by reference).

Additional suitable strategies for generating fusion proteins comprising an RNA-guided, DNA-binding domain and a deaminase domain will be apparent to those of skill in the art based on this disclosure in combination with the general knowledge in the art. Suitable strategies for generating fusion proteins according to aspects of this disclosure using linkers or without the use of linkers will also be apparent to those of skill in the art view of the instant disclosure and the knowledge in the art.

In some embodiments, the RNA-guided, DNA-binding domain is an RGN protein variant that has nickase activity. In some embodiments, the RNA-guided, DNA-binding domain is a RGN nickase. In some embodiments, the RGN is an RGN of the invention. In other embodiments, the RGN is not an RGN of the invention. The RGN nickase may be a Cas9 protein that is capable of cleaving only one strand of a duplexed nucleic acid molecule (e.g., a duplexed DNA molecule, also referred to as a double-stranded DNA molecule). In some embodiments the RGN nickase cleaves the target strand of a duplexed nucleic acid molecule, meaning that the RGN nickase cleaves the strand that is base paired to (complementary to) a gRNA that is bound to the RGN. In some embodiments, the RGN nickase comprises a D10A mutation, or the equivalent mutation. In other embodiments, the RGN nickase comprises a H840A mutation, or the equivalent mutation. For example, an RGN nickase may comprise the amino acid sequence as set forth in SEQ ID NO: 569. In some embodiments the RGN nickase is a D10A Cas9 nickase, which inactivates the RuvC domain of the Cas9 and results in cleavage of the target, non-base edited strand of a duplexed nucleic acid molecule, meaning that the D10A Cas9 nickase cleaves the strand that is base paired to a gRNA (e.g., an sgRNA) that is bound to the Cas9. In some embodiments, a Cas9 nickase comprises an H840A mutation, which inactivates the HNH domain of the Cas9 polypeptide. The H840A Cas9 nickase will cleave the non-target, based-edited strand. In some embodiments the RGN nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to SEQ ID NO: 568, 569, 547, or 553. Additional suitable RGN proteins mutated to be nickases will be apparent to those of skill in the art based on this disclosure and knowledge in the field (such as for example the RGNs disclosed in U.S. patent application Ser. No. 16/432,321) and are within the scope of this disclosure.

Some aspects of the disclosure relate to fusion proteins that comprise a uracil glycosylase inhibitor (UGI) domain. In some embodiments, any of the fusion proteins provided herein that comprise an RNA-guided, DNA-binding domain (e.g., a nuclease active RGN domain, or an RGN variant that is nuclease inactive or functions as a nickase) may be further fused to at least one UGI domain either directly or via a linker. In some embodiments, the fusion protein is further fused to at least two UGI domains, either directly or via a linker. Some aspects of this disclosure provide deaminase-RGN fusion proteins, deaminase-nuclease inactive RGN fusion proteins and deaminase-nickase RGN fusion proteins, further fused to at least one UGI domain and with increased C→T nucleobase editing efficiency as compared to a similar fusion protein that does not comprise a UGI domain. Without wishing to be bound by any particular theory, cellular DNA-repair response to the presence of U:G heteroduplex DNA may be responsible for the decrease in nucleobase editing efficiency in cells. For example, uracil DNA glycosylase (UDG) catalyzes removal of U from DNA in cells, which may initiate base excision repair, with reversion of the U:G pair to a C:G pair as the most common outcome.

This disclosure contemplates a fusion protein comprising a deaminase of the invention and an RNA-guided, DNA-binding polypeptide further fused to a UGI domain. This disclosure also contemplates a fusion protein comprising a deaminase, an RGN nickase or a nuclease inactive RGN polypeptide, further fused to a UGI domain. It should be understood that the use of a UGI domain may increase the editing efficiency of a nucleic acid editing domain that is capable of catalyzing a C to U change. For example, fusion proteins comprising a UGI domain may be more efficient in deaminating C residues. In some embodiments, the fusion protein comprises the structure: [deaminase]-[optional linker sequence]-[nuclease-inactive RGN]-[optional linker sequence]-[UGI]; [deaminase]-[optional linker sequence]-[UGI]-[optional linker sequence]-[nuclease-inactive RGN]; [UGI]-[optional linker sequence]-[deaminase]-[optional linker sequence]-[nuclease-inactive RGN]; [UGI]-[optional linker sequence]-[nuclease-inactive RGN]-[optional linker sequence]-[deaminase]; [nuclease-inactive RGN]-[optional linker sequence]-[deaminase]-[optional linker sequence]-[UGI]; or [nuclease-inactive RGN]-[optional linker sequence]-[UGI]-[optional linker sequence]-[deaminase]. It should be understood that "nuclease-inactive RGN" represents any RGN, including any CRISPR-Cas protein, which has been mutated to be nuclease-inactive. It should also be understood that "UGI" represents one or more UGI domains.

In other embodiments, the fusion protein comprises the structure: [deaminase]-[optional linker sequence]-[RGN nickase]-[optional linker sequence]-[UGI]; [deaminase]-[optional linker sequence]-[UGI]-[optional linker sequence]-[RGN nickase]; [UGI]-[optional linker sequence]-[deaminase][optional linker sequence]-[RGN nickase]; [UGI]-[optional linker sequence]-[RGN nickase]-[optional linker sequence]-[deaminase]; [RGN nickase]-[optional linker sequence][deaminase]-[optional linker sequence]-[UGI]; or [RGN nickase]-[optional linker sequence]-[UGI]-[optional linker sequence]-[deaminase]. It should be understood that "RGN nickase" represents any RGN, including any CRISPR-Cas protein, which has been mutated to be active as a nickase. It should also be understood that "UGI" represents one or more UGI domains.

In some embodiments, the fusion proteins provided herein do not comprise a linker sequence. In some embodiments, one or both of the optional linker sequences are present.

In some embodiments, the "-" used in the general architecture above indicates the presence of an optional linker sequence. In some embodiments, the fusion proteins comprising a UGI further comprise a nuclear targeting sequence, for example a nuclear localization sequence. In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the UGI protein. In some embodiments, the NLS is fused to the C-terminus of the UGI protein. In some embodiments, the NLS is fused to the N-terminus of the RGN protein. In some embodiments, the NLS is fused to the C-terminus of the RGN protein. In some embodiments, the NLS is fused to the N-terminus of the deaminase. In some embodiments, the NLS is fused to the C-terminus of the deaminase. In some embodiments, the NLS is fused to the N-terminus of the second RGN. In some embodiments, the NLS is fused to the C-terminus of the second RGN. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 10.

In some embodiments, a UGI domain comprises a wild-type UGI or a UGI as set forth in SEQ ID NO: 570. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 570. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 570. In some embodiments, a UGI comprises an amino acid sequence homologous to the amino acid sequence set forth in SEQ ID NO: 570 or an amino acid sequence homologous to a fragment of the amino acid sequence set forth in SEQ ID NO: 570. In some embodiments, proteins comprising UGI or fragments of UGI or homologs of UGI or UGI fragments are referred to as "UGI variants." A UGI variant shares homology to UGI, or a fragment thereof. For example, a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 570. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 570.

Suitable UGI protein and nucleotide sequences are provided herein and additional suitable UGI sequences are known to those in the art, and include, for example, those published in Wang et al., 1989. J. Biol. Chem. 264: 1163-1171; Lundquist et al., 1997. J. Biol. Chem. 272:21408-21419; Ravishankar et al., 1998. Nucleic Acids Res. 26:4880-4887; and Putnam et al., 1999. J. Mol. Biol. 287: 331-346(1999), the entire contents of each are incorporated herein by reference.

It should be appreciated that additional proteins may be uracil glycosylase inhibitors. For example, other proteins that are capable of inhibiting (e.g., sterically blocking) a uracil-DNA glycosylase base-excision repair enzyme are within the scope of this disclosure. Additionally, any proteins that block or inhibit base-excision repair as also within the scope of this disclosure. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a *Erwinia tasmaniensis* single-stranded binding protein. In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. It should be appreciated that other uracil glycosylase inhibitors would be apparent to the skilled artisan and are within the scope of this disclosure. A suitable UGI protein sequence is provided herein (SEQ ID NO: 570) and additional suitable UGI sequences are known to those in the art, and include, for example, those published in Wang et al., 1989. J. Biol. Chem. 264: 1163-1171; Lundquist et al., 1997. J. Biol. Chem. 272:21408-21419; Ravishankar et al 1998. Nucleic Acids Res. 26:4880-4887; and Putnam et al., 1999. J. Mol. Biol. 287:331-346, the entire contents of which are incorporated herein by reference. In some embodiments, the optional linker comprises a $(SGGS)_n$ (SEQ ID NO: 592) motif, wherein n is 1, 2, 3, 4, 5, 6, 7, 8, 9, 19, 11, 12, 13, 14, 15, 16, 17, 18, 19, or 20. In some embodiments, the optional linker comprises the amino acid sequence as set forth in SEQ ID NO: 546

In certain embodiments, the presently disclosed fusion proteins comprise at least one cell-penetrating domain that facilitates cellular uptake of the RGN. Cell-penetrating domains are known in the art and generally comprise stretches of positively charged amino acid residues (i.e., polycationic cell-penetrating domains), alternating polar amino acid residues and non-polar amino acid residues (i.e., amphipathic cell-penetrating domains), or hydrophobic amino acid residues (i.e., hydrophobic cell-penetrating domains) (see, e.g., Milletti F. (2012) *Drug Discov Today* 17:850-860). A non-limiting example of a cell-penetrating domain is the trans-activating transcriptional activator (TAT) from the human immunodeficiency virus 1.

The nuclear localization signal, plastid localization signal, mitochondrial localization signal, dual-targeting localization signal, and/or cell-penetrating domain can be located at the amino-terminus (N-terminus), the carboxyl-terminus (C-terminus), or in an internal location of the fusion protein.

Another embodiment of the invention is a ribonucleoprotein complex comprising the fusion protein and the guide RNA, either as a single guide or as a dual guide RNA (collectively referred to as gRNA).

IV. Nucleotides Encoding RNA-Guided Nucleases, RNA-Guided DNA Binding Polypeptides, Deaminases, CRISPR RNA, tracrRNA, and gRNA The present disclosure provides polynucleotides comprising the presently disclosed RGNs, RNA-guided, DNA-binding polypeptide-deaminase fusions, deaminases, CRISPR RNAs, tracrRNAs, and/or sgRNAs. Presently disclosed polynucleotides include those comprising or encoding a CRISPR repeat sequence comprising the nucleotide sequence of SEQ ID NOs: 2, 17, 25, 36, 44, 51, or 63, or an active variant or fragment thereof that when comprised within a guide RNA is capable of directing the sequence-specific binding of an associated RNA-guided nuclease to a target sequence of interest. Also disclosed are polynucleotides comprising or encoding a tracrRNA comprising the nucleotide sequence of SEQ ID NOs: 3, 18, 26, 37, 45, 52, or 62, or an active variant or fragment thereof that when comprised within a guide RNA is capable of directing the sequence-specific binding of an associated RNA-guided nuclease to a target sequence of interest. Polynucleotides are also provided that encode an RGN comprising the amino acid sequence set forth as SEQ ID NOs: 1, 16, 24, 35, 43, or 50, and active fragments or variants thereof that retain the ability to bind to a target nucleotide sequence in an RNA-guided sequence-specific manner.

The present disclosure further provides polynucleotides encoding for fusion proteins which comprise a deaminase recited herein (SEQ ID NOs: 374-545 and 572-584, or an active variant thereof) and a DNA binding polypeptide, for example a meganuclease, a zinc finger fusion protein, or a TALEN. The present disclosure further provides polynucleotides encoding for fusion proteins which comprise a deaminase recited herein and an RNA-guided, DNA-binding polypeptide. Such an RNA-guided, DNA-binding polypeptide may be an RGN of the invention, an RGN known in the art, a CRISPR-Cas protein, or a protein variant of any thereof. The protein variant may be nuclease-inactive or a nickase. Examples of such RGN variants include a nuclease-inactive RGN (SEQ ID NO: 568 or SEQ ID NO: 547) or a RGN nickase mutant (SEQ ID NO: 569 or SEQ ID NO: 553). Other examples of RGN nucleases are well-known in the art, and similar corresponding mutations can create mutant variants which are also nuclease inactive or nickases.

The use of the term "polynucleotide" is not intended to limit the present disclosure to polynucleotides comprising DNA. Those of ordinary skill in the art will recognize that polynucleotides can comprise ribonucleotides (RNA) and combinations of ribonucleotides and deoxyribonucleotides. Such deoxyribonucleotides and ribonucleotides include both naturally occurring molecules and synthetic analogues. These include peptide nucleic acids (PNAs), PNA-DNA chimers, locked nucleic acids (LNAs), and phosphothiorate linked sequences. The polynucleotides disclosed herein also encompass all forms of sequences including, but not limited to, single-stranded forms, double-stranded forms, DNA-RNA hybrids, triplex structures, stem-and-loop structures, and the like.

The nucleic acid molecules encoding RGNs, deaminases, or fusion proteins can be codon optimized for expression in an organism of interest. A "codon-optimized" coding sequence is a polynucleotide coding sequence having its frequency of codon usage designed to mimic the frequency of preferred codon usage or transcription conditions of a particular host cell. Expression in the particular host cell or organism is enhanced as a result of the alteration of one or more codons at the nucleic acid level such that the translated amino acid sequence is not changed. Nucleic acid molecules can be codon optimized, either wholly or in part. Codon tables and other references providing preference information for a wide range of organisms are available in the art (see, e.g., Campbell and Gown (1990) *Plant Physiol.* 92:1-11 for a discussion of plant-preferred codon usage). Methods are available in the art for synthesizing plant-preferred genes. See, for example, U.S. Pat. Nos. 5,380,831, and 5,436,391, and Murray et al. (1989) *Nucleic Acids Res.* 17:477-498, herein incorporated by reference.

Polynucleotides encoding the RGNs, RNA-guided, DNA-binding polypeptide-deaminase fusions, deaminases, crRNAs, tracrRNAs, and/or sgRNAs provided herein can be provided in expression cassettes for in vitro expression or expression in a cell, organelle, embryo, or organism of interest. The cassette will include 5' and 3' regulatory sequences operably linked to a polynucleotide encoding an RGN, RNA-guided, DNA-binding polypeptide-deaminase fusion, deaminase, crRNA, tracrRNAs, and/or sgRNAs provided herein that allows for expression of the polynucleotide. The cassette may additionally contain at least one additional gene or genetic element to be cotransformed into the organism. Where additional genes or elements are included, the components are operably linked. The term "operably linked" is intended to mean a functional linkage between two or more elements. For example, an operable linkage between a promoter and a coding region of interest (e.g., region coding for an RGN, RNA-guided, DNA-binding polypeptide-deaminase fusion, deaminase, crRNA, tracrRNAs, and/or sgRNAs) is a functional link that allows for expression of the coding region of interest. Operably linked elements may be contiguous or non-contiguous. When used to refer to the joining of two protein coding regions, by operably linked is intended that the coding regions are in the same reading frame. Alternatively, the additional gene(s) or element(s) can be provided on multiple expression cassettes. For example, the nucleotide sequence encoding a presently disclosed RGN can be present on one expression cassette, whereas the nucleotide sequence encoding a crRNA, tracrRNA, or complete guide RNA can be on a separate expression cassette. Such an expression cassette is provided with a plurality of restriction sites and/or recombination sites for insertion of the polynucleotides to be under the transcriptional regulation of the regulatory regions. The expression cassette may additionally contain a selectable marker gene.

The expression cassette will include in the 5'-3' direction of transcription, a transcriptional (and, in some embodiments, translational) initiation region (i.e., a promoter), an RGN-, RNA-guided, DNA-binding polypeptide-deaminase fusion-, deaminase-, crRNA-, tracrRNA- and/or sgRNA-encoding polynucleotide of the invention, and a transcriptional (and in some embodiments, translational) termination region (i.e., termination region) functional in the organism of interest. The promoters of the invention are capable of directing or driving expression of a coding sequence in a host cell. The regulatory regions (e.g., promoters, transcriptional regulatory regions, and translational termination regions) may be endogenous or heterologous to the host cell or to each other. As used herein, "heterologous" in reference to a sequence is a sequence that originates from a foreign species, or, if from the same species, is substantially modified from its native form in composition and/or genomic locus by deliberate human intervention. As used herein, a chimeric gene comprises a coding sequence operably linked to a transcription initiation region that is heterologous to the coding sequence.

Convenient termination regions are available from the Ti-plasmid of *A. tumefaciens*, such as the octopine synthase and nopaline synthase termination regions. See also Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Additional regulatory signals include, but are not limited to, transcriptional initiation start sites, operators, activators, enhancers, other regulatory elements, ribosomal binding sites, an initiation codon, termination signals, and the like.

See, for example, U.S. Pat. Nos. 5,039,523 and 4,853,331; EPO 0480762A2; Sambrook et al. (1992) Molecular Cloning: A Laboratory Manual, ed. Maniatis et al. (Cold Spring Harbor Laboratory Press, Cold Spring Harbor, N.Y.), hereinafter "Sambrook 11"; Davis et al., eds. (1980) Advanced Bacterial Genetics (Cold Spring Harbor Laboratory Press), Cold Spring Harbor, N.Y., and the references cited therein.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, inducible, growth stage-specific, cell type-specific, tissue-preferred, tissue-specific, or other promoters for expression in the organism of interest. See, for example, promoters set forth in WO 99/43838 and in U.S. Pat. Nos. 8,575,425; 7,790,846; 8,147,856; 8,586,832; 7,772,369; 7,534,939; 6,072,050; 5,659,026; 5,608,149; 5,608,144; 5,604,121; 5,569,597; 5,466,785; 5,399,680; 5,268,463; 5,608,142; and 6,177,611; herein incorporated by reference.

For expression in plants, constitutive promoters also include CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); and MAS (Velten et al. (1984) *EMBO J.* 3:2723-2730).

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the Axig1 promoter which is auxin induced and tapetum specific but also active in callus (PCT US01/22169), the steroid-responsive promoters (see, for example, the ERE promoter which is estrogen induced, and the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-specific or tissue-preferred promoters can be utilized to target expression of an expression construct within a particular tissue. In certain embodiments, the tissue-specific or tissue-preferred promoters are active in plant tissue. Examples of promoters under developmental control in plants include promoters that initiate transcription preferentially in certain tissues, such as leaves, roots, fruit, seeds, or flowers. A "tissue specific" promoter is a promoter that initiates transcription only in certain tissues. Unlike constitutive expression of genes, tissue-specific expression is the result of several interacting levels of gene regulation. As such, promoters from homologous or closely related plant species can be preferable to use to achieve efficient and reliable expression of transgenes in particular tissues. In some embodiments, the expression comprises a tissue-preferred promoter. A "tissue preferred" promoter is a promoter that initiates transcription preferentially, but not necessarily entirely or solely in certain tissues.

In some embodiments, the nucleic acid molecules encoding a RGN, RNA-guided, DNA-binding polypeptide-deaminase fusion, deaminase, crRNA, and/or tracrRNA comprise a cell type-specific promoter. A "cell type specific" promoter is a promoter that primarily drives expression in certain cell types in one or more organs. Some examples of plant cells in which cell type specific promoters functional in plants may be primarily active include, for example, BETL cells, vascular cells in roots, leaves, stalk cells, and stem cells. The nucleic acid molecules can also include cell type preferred promoters. A "cell type preferred" promoter is a promoter that primarily drives expression mostly, but not necessarily entirely or solely in certain cell types in one or more organs. Some examples of plant cells in which cell type preferred promoters functional in plants may be preferentially active include, for example, BETL cells, vascular cells in roots, leaves, stalk cells, and stem cells.

The nucleic acid sequences encoding the RGNs, RNA-guided, DNA-binding polypeptide-deaminase fusions, deaminases, crRNAs, tracrRNAs, and/or sgRNAs can be operably linked to a promoter sequence that is recognized by a phage RNA polymerase for example, for in vitro mRNA synthesis. In such embodiments, the in vitro-transcribed RNA can be purified for use in the methods described herein. For example, the promoter sequence can be a T7, T3, or SP6 promoter sequence or a variation of a T7, T3, or SP6 promoter sequence. In such embodiments, the expressed protein and/or RNAs can be purified for use in the methods of genome modification described herein.

In certain embodiments, the polynucleotide encoding the RGN, RNA-guided, DNA-binding polypeptide-deaminase fusion, deaminase, crRNA, tracrRNA, and/or sgRNA also can be linked to a polyadenylation signal (e.g., SV40 polyA signal and other signals functional in plants) and/or at least one transcriptional termination sequence. Additionally, the sequence encoding the RGN, RNA-guided, DNA-binding polypeptide-deaminase fusion, or deaminase also can be linked to sequence(s) encoding at least one nuclear localization signal, at least one cell-penetrating domain, and/or at least one signal peptide capable of trafficking proteins to particular subcellular locations, as described elsewhere herein.

The polynucleotide encoding the RGN, RNA-guided, DNA-binding polypeptide-deaminase fusion, deaminase, crRNA, tracrRNA, and/or sgRNA can be present in a vector or multiple vectors. A "vector" refers to a polynucleotide composition for transferring, delivering, or introducing a nucleic acid into a host cell. Suitable vectors include plasmid vectors, phagemids, cosmids, artificial/mini-chromosomes, transposons, and viral vectors (e.g., lentiviral vectors, adeno-associated viral vectors, baculoviral vector). The vector can comprise additional expression control sequences (e.g., enhancer sequences, Kozak sequences, polyadenylation sequences, transcriptional termination sequences), selectable marker sequences (e.g., antibiotic resistance genes), origins of replication, and the like. Additional information can be found in "Current Protocols in Molecular Biology" Ausubel et al., John Wiley & Sons, New York, 2003 or "Molecular Cloning: A Laboratory Manual" Sambrook & Russell, Cold Spring Harbor Press, Cold Spring Harbor, N.Y., 3rd edition, 2001.

The vector can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D).

In some embodiments, the expression cassette or vector comprising the sequence encoding the RGN polypeptide, RNA-guided, DNA-binding polypeptide-deaminase fusion, or deaminase can further comprise a sequence encoding a crRNA and/or a tracrRNA, or the crRNA and tracrRNA combined to create a guide RNA. The sequence(s) encoding the crRNA and/or tracrRNA can be operably linked to at least one transcriptional control sequence for expression of the crRNA and/or tracrRNA in the organism or host cell of interest. For example, the polynucleotide encoding the crRNA and/or tracrRNA can be operably linked to a promoter sequence that is recognized by RNA polymerase III (Pol III). Examples of suitable Pol III promoters include, but are not limited to, mammalian U6, U3, H1, and 7SL RNA promoters and rice U6 and U3 promoters.

As indicated, expression constructs comprising nucleotide sequences encoding the RGN, RNA-guided, DNA-binding polypeptide-deaminase fusion, deaminase, crRNA, tracrRNA, and/or sgRNA can be used to transform organisms of interest. Methods for transformation involve introducing a nucleotide construct into an organism of interest. By "introducing" is intended to introduce the nucleotide construct to the host cell in such a manner that the construct gains access to the interior of the host cell. The methods of the invention do not require a particular method for introducing a nucleotide construct to a host organism, only that the nucleotide construct gains access to the interior of at least one cell of the host organism. The host cell can be a eukaryotic or prokaryotic cell. In particular embodiments, the eukaryotic host cell is a plant cell, a mammalian cell, or an insect cell. Methods for introducing nucleotide constructs into plants and other host cells are known in the art including, but not limited to, stable transformation methods, transient transformation methods, and virus-mediated methods.

The methods result in a transformed organism, such as a plant, including whole plants, as well as plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic organisms" or "transformed organisms" or "stably transformed" organisms or cells or tissues refers to organisms that have incorporated or integrated a polynucleotide encoding a RGN, RNA-guided, DNA-binding polypeptide-deaminase fusion, deaminase, crRNA, and/or tracrRNA of the invention. It is recognized that other exogenous or endogenous nucleic acid sequences or DNA fragments may also be incorporated into the host cell. *Agrobacterium*- and biolistic-mediated transformation remain the two predominantly employed approaches for transformation of plant cells. However, transformation of a host cell may be performed by infection, transfection, microinjection, electroporation, microprojection, biolistics or particle bombardment, electroporation, silica/carbon fibers, ultrasound mediated, PEG mediated, calcium phosphate co-precipitation, polycation DMSO technique, DEAE dextran procedure, and viral mediated, liposome mediated and the like. Viral-mediated introduction of a polynucleotide encoding an RGN, RNA-guided, DNA-binding polypeptide-deaminase fusion, deaminase, crRNA, and/or tracrRNA includes retroviral, lentiviral, adenoviral, and adeno-associated viral mediated introduction and expression, as well as the use of Caulimoviruses, Geminiviruses, and RNA plant viruses.

Transformation protocols as well as protocols for introducing polypeptides or polynucleotide sequences into plants may vary depending on the type of host cell (e.g., monocot or dicot plant cell) targeted for transformation. Methods for transformation are known in the art and include those set forth in U.S. Pat. Nos. 8,575,425; 7,692,068; 8,802,934; 7,541,517; each of which is herein incorporated by reference. See, also, Rakoczy-Trojanowska, M. (2002) *Cell Mol Biol Lett.* 7:849-858; Jones et al. (2005) *Plant Methods* 1:5; Rivera et al. (2012) *Physics of Life Reviews* 9:308-345; Bartlett et al. (2008) *Plant Methods* 4:1-12; Bates, G. W. (1999) *Methods in Molecular Biology* 111:359-366; Binns and Thomashow (1988) *Annual Reviews in Microbiology* 42:575-606; Christou, P. (1992) *The Plant Journal* 2:275-281; Christou, P. (1995) *Euphytica* 85:13-27; Tzfira et al. (2004) *TRENDS in Genetics* 20:375-383; Yao et al. (2006) *Journal of Experimental Botany* 57:3737-3746; Zupan and Zambryski (1995) *Plant Physiology* 107:1041-1047; Jones et al. (2005) *Plant Methods* 1:5;

Transformation may result in stable or transient incorporation of the nucleic acid into the cell. "Stable transformation" is intended to mean that the nucleotide construct introduced into a host cell integrates into the genome of the host cell and is capable of being inherited by the progeny thereof. "Transient transformation" is intended to mean that a polynucleotide is introduced into the host cell and does not integrate into the genome of the host cell.

Methods for transformation of chloroplasts are known in the art. See, for example, Svab et al. (1990) *Proc. Nail. Acad. Sci. USA* 87:8526-8530; Svab and Maliga (1993) *Proc. Natl. Acad. Sci. USA* 90:913-917; Svab and Maliga (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) *Proc. Natl. Acad. Sci. USA* 91:7301-7305.

The cells that have been transformed may be grown into a transgenic organism, such as a plant, in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

Alternatively, cells that have been transformed may be introduced into an organism. These cells could have originated from the organism, wherein the cells are transformed in an ex vivo approach.

The sequences provided herein may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassaya, coffee, coconut, pineapple, citrus trees, cocoa, tea, banana, avocado, fig, guava, mango, olive, *papaya*, cashew, macadamia, almond, oats, vegetables, ornamentals, and conifers.

Vegetables include, but are not limited to, tomatoes, lettuce, green beans, lima beans, peas, and members of the genus Curcumis such as cucumber, cantaloupe, and musk melon. Ornamentals include, but are not limited to, azalea, hydrangea, hibiscus, roses, tulips, daffodils, petunias, carnation, poinsettia, and *chrysanthemum*. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides. Further provided is a processed plant product or byproduct that retains the sequences disclosed herein, including for example, soymeal.

The polynucleotides encoding the RGNs, RNA-guided, DNA-binding polypeptide-deaminase fusions, deaminases, crRNAs, and/or tracrRNAs can also be used to transform any prokaryotic species, including but not limited to, archaea and bacteria (e.g., *Bacillus* sp., *Klebsiella* sp. *Streptomyces* sp., *Rhizobium* sp., *Escherichia* sp., *Pseudomonas* sp., *Salmonella* sp., *Shigella* sp., *Vibrio* sp., *Yersinia* sp., *Mycoplasma* sp., *Agrobacterium, Lactobacillus* sp.).

The polynucleotides encoding the RGNs, RNA-guided, DNA-binding polypeptide-deaminase fusions, deaminases, crRNAs, and/or tracrRNAs can be used to transform any eukaryotic species, including but not limited to animals (e.g., mammals, insects, fish, birds, and reptiles), fungi, amoeba, algae, and yeast.

Conventional viral and non-viral based gene transfer methods can be used to introduce nucleic acids in mammalian cells or target tissues. Such methods can be used to administer nucleic acids encoding components of a CRISPR system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256: 808-813 (1992); Nabel & Feigner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10): 1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Feigner, WO 91/17424; WO 91/16024. Delivery can be to cells (e.g. in vitro or ex vivo administration) or target tissues (e.g. in vivo administration). The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Viral. 66:2731-2739 (1992); Johann et al., J. Viral. 66:1635-1640 (1992); Sommnerfelt et al., Viral. 176:58-59 (1990); Wilson et al., J. Viral. 63:2374-2378 (1989); Miller et al., 1. Viral. 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Katin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Viral. 63:03822-3828 (1989). Packaging cells are typically used to form virus particles that are capable of infecting a host cell. Such cells include 293 cells, which package adenovirus, and ψJ2 cells or PA317 cells, which package retrovirus.

Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences.

The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLaS3, Huhl, Huh4, Huh7, HUVEC, HASMC, HEKn, HEKa, MiaPaCell, Panel, PC-3, TFl, CTLL-2, CIR, Rath, CVI, RPTE, AlO, T24, 182, A375, ARH-77, Calul, SW480, SW620, SKOV3, SK-UT, CaCo2, P388Dl, SEM-K2, WEHI-231, HB56, TIB55, lurkat, 145.01, LRMB, Bcl-1, BC-3, IC21, DLD2, Raw264.7, NRK, NRK-52E, MRCS, MEF, Hep G2, HeLa B, HeLa T4. COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-I cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr–/–, COR-L23, COR-L23/CPR, COR-L235010, CORL23/R23, COS-7, COV-434, CML Tl, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, lurkat, lY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCKII, MDCKII, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

In some embodiments, a cell transfected with one or more vectors described herein is used to establish a new cell line comprising one or more vector-derived sequences. In some embodiments, a cell transiently transfected with the components of a CRISPR system or deaminase or fusion thereof as described herein (such as by transient transfection of one or more vectors, or transfection with RNA), and modified through the activity of a CRISPR complex or deaminase, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, or rabbit. In some embodiments, transgenic human cells are produced.

V. Variants and Fragments of Polypeptides and Polynucleotides

The present disclosure provides active variants and fragments of naturally-occurring (i.e., wild-type) RNA-guided nucleases and deaminases, the amino acid sequences of which are set forth as SEQ ID NOs: 1, 16, 24, 35, 43, 50, 374-545, 572-590, and active variants thereof, as well as active variants and fragments of naturally-occurring CRISPR repeats, such as the sequence set forth as SEQ ID NOs: 2, 17, 25, 36, 44, 51, or 63, and active variant and fragments of naturally-occurring tracrRNAs, such as the sequence set forth as SEQ ID NOs: 3, 18, 26, 37, 45, 52, or 62, and polynucleotides encoding the same. Also provided are active variants and fragments of deaminases, such as the sequences set forth as SEQ ID NOs: 374-545 and 572-584.

While the activity of a variant or fragment may be altered compared to the polynucleotide or polypeptide of interest, the variant and fragment should retain the functionality of the polynucleotide or polypeptide of interest. For example, a variant or fragment may have increased activity, decreased activity, different spectrum of activity or any other alteration in activity when compared to the polynucleotide or polypeptide of interest.

Fragments and variants of naturally-occurring RGN polypeptides, such as those disclosed herein, will retain sequence-specific, RNA-guided DNA-binding activity. In particular embodiments, fragments and variants of naturally-occurring RGN polypeptides, such as those disclosed herein, will retain nuclease activity (single-stranded or double-stranded). In other embodiments, fragments and variants of naturally-occurring deaminases, such as those disclosed herein, will retain deaminase activity. In some embodiments, the deaminase variants have altered activity, such as for example activity on DNA templates, or activity on nucleotides different from the native deaminase, such as for example activity on adenosine.

Fragments and variants of naturally-occurring CRISPR repeats, such as those disclosed herein, will retain the ability, when part of a guide RNA (comprising a tracrRNA), to bind to and guide an RNA-guided nuclease (complexed with the guide RNA) to a target nucleotide sequence in a sequence-specific manner.

Fragments and variants of naturally-occurring tracrRNAs, such as those disclosed herein, will retain the ability, when part of a guide RNA (comprising a CRISPR RNA), to guide an RNA-guided nuclease (complexed with the guide RNA) to a target nucleotide sequence in a sequence-specific manner.

The term "fragment" refers to a portion of a polynucleotide or polypeptide sequence of the invention. "Fragments" or "biologically active portions" include polynucleotides comprising a sufficient number of contiguous nucleotides to retain the biological activity (i.e., binding to and directing an RGN in a sequence-specific manner to a target nucleotide sequence when comprised within a guideRNA). "Fragments" or "biologically active portions" include polypeptides comprising a sufficient number of contiguous amino acid residues to retain the biological activity (i.e., binding to a target nucleotide sequence in a sequence-specific manner when complexed with a guide RNA). Fragments of the RGN proteins include those that are shorter than the full-length sequences due to the use of an alternate downstream start site. A biologically active portion of an RGN protein can be a polypeptide that comprises, for example, 10, 25, 50, 100, 150, 200, 250, 300, 350, 400, 450, 500, 550, 600, 650, 700, 750, 800, 850, 900, 950, 1000, 1050 or more contiguous amino acid residues of SEQ ID NOs: 1, 16, 24, 35, 43, or 50. Such biologically active portions can be prepared by recombinant techniques and evaluated for sequence-specific, RNA-guided DNA-binding activity. A biologically active fragment of a CRISPR repeat sequence can comprise at least 8 contiguous nucleic acids of SEQ ID NOs: 2, 17, 25, 36, 44, 51, or 63. A biologically active portion of a CRISPR repeat sequence can be a polynucleotide that comprises, for example, 8, 9, 10, 11, 12, 13, 14, 15, 16, 17, 18, 19, or 20 contiguous nucleotides of SEQ ID NOs: 2, 17, 25, 36, 44, 51, or 63. A biologically active portion of a tracrRNA can be a polynucleotide that comprises, for example, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80 or more contiguous nucleotides of SEQ ID NOs: 3, 18, 26, 37, 45, 52, or 62. A biologically active portion of a deaminase can be a polypeptide that comprises, for example, 10, 25, 50, 100, 150, 200 or more contiguous amino acid residues of any one of SEQ ID NOs: 374-545 and 572-584.

In general, "variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a "native" or "wild type" polynucleotide or polypeptide comprises a naturally occurring nucleotide sequence or amino acid sequence, respectively. For polynucleotides, conservative variants include those sequences that, because of the degeneracy of the genetic code, encode the native amino acid sequence of the gene of interest. Naturally occurring allelic variants such as these can be identified with the use of well-known molecular biology techniques, as, for example, with polymerase chain reaction (PCR) and hybridization techniques as outlined below. Variant polynucleotides also include synthetically derived polynucleotides, such as those generated, for example, by using site-directed mutagenesis but which still encode the polypeptide or the polynucleotide of interest. Generally, variants of a particular polynucleotide disclosed herein will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

Variants of a particular polynucleotide disclosed herein (i.e., the reference polynucleotide) can also be evaluated by comparison of the percent sequence identity between the polypeptide encoded by a variant polynucleotide and the polypeptide encoded by the reference polynucleotide. Percent sequence identity between any two polypeptides can be calculated using sequence alignment programs and parameters described elsewhere herein. Where any given pair of polynucleotides disclosed herein is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

In particular embodiments, the presently disclosed polynucleotides encode a deaminase polypeptide comprising an amino acid sequence having at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to an amino acid sequence of any of SEQ ID NOs: 374-545 or 572-584. In certain embodiments, the deaminase has an amino acid sequence of at least 50%, at least 55%, at least 60%, at least 65%, at least 70%, at least 75%, at least 80%, at least 85%, at least 90%, at least 95%, at least 96%, at least 97%, at least 98%, or at least 99% identity to the amino acid sequence of any of SEQ ID NOs: 374, 383, 397, 399, 407, 408, 411, 414, 416, 420, 514, and 572-584. In some of these embodiments, the variant deaminase polypeptide has a certain level of sequence identity to any one of SEQ ID NOs: 572-584, wherein specific amino acid residues are unchanged from the parent sequence. For example, in some embodiments, a variant SEQ ID NO: 572 comprises a lysine at a position corresponding to position 102, a tyrosine at a position corresponding to position 104, and a threonine at a position corresponding to position 106 of SEQ ID NO: 572. In particular embodiments, a variant SEQ ID NO: 574 comprises a glutamic acid at a position corresponding to position 101, a serine at a position corresponding to position 103, and a lysine at a position corresponding to position 105 of SEQ ID NO: 574. In certain embodiments, a variant SEQ ID NO: 575 comprises a lysine at a position corresponding to position 101, a leucine at a position corresponding to position 103, and a glutamic acid at a position corresponding to position 105 of SEQ ID NO: 575. In some embodiments, a variant SEQ ID NO: 576 comprises an alanine at a position corresponding to position 105 and an argnine at a position corresponding to position 107 of SEQ ID NO: 576. In particular embodiments, a variant SEQ ID NO: 577 comprises a glycine at a position corresponding to position 102, a serine at a position corresponding to position 104, and an arginine at a position corresponding to position 106 of SEQ ID NO: 577. In certain embodiments, a variant SEQ ID NO: 578 comprises a serine at a position corresponding to position 105 and a threonine at a position corresponding to position 107 of SEQ ID NO: 578. In some embodiments, a variant SEQ ID NO: 579 comprises a serine at a position corresponding to position 102, a glutamine at a position corresponding to position 104, and a glycine at a position corresponding to position 106 of SEQ ID NO: 579. In particular embodiments, a variant SEQ ID NO: 580 comprises a glycine at a position corresponding to position 111 of SEQ ID NO: 580. In some embodiments, a variant SEQ ID NO: 581 comprises a glutamine at a position corresponding to position 104, a glycine at a position corresponding to position 106, and a glutamic acid at a position corresponding to position 108 of SEQ ID NO: 581. In certain embodiments, a variant SEQ ID NO: 582 comprises an arginine at a position corresponding to position 102, a tryptophan at a position corresponding to position 104, and a glutamic acid at a position corresponding to position 106 of SEQ ID NO: 582. In certain embodiments, a variant SEQ ID NO: 583 comprises an arginine at a position corresponding to position 104 and a serine at a position corresponding to position 106 of SEQ ID NO: 583. In particular embodiments, a variant SEQ ID NO: 584 comprises a phenylalanine at a position corresponding to position 110, a serine at a position corresponding to position 112, and a threonine at a position corresponding to position 114 of SEQ ID NO: 584.

A biologically active variant of a deaminase polypeptide of the invention may differ by as few as about 1-15 amino acid residues, as few as about 1-10, such as about 6-10, as few as 5, as few as 4, as few as 3, as few as 2, or as few as 1 amino acid residue. In specific embodiments, the polypeptides can comprise an N-terminal or a C-terminal truncation, which can comprise at least a deletion of 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000, 1050 amino acids or more from either the N or C terminus of the polypeptide.

In other particular embodiments, the presently disclosed polynucleotides encode an RNA-guided nuclease polypeptide comprising an amino acid sequence having at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to an amino acid sequence of SEQ ID NOs: 1, 16, 24, 35, 43, or 50.

A biologically active variant of an RGN or deaminase polypeptide of the invention may differ by as few as about 1-15 amino acid residues, as few as about 1-10, such as about 6-10, as few as 5, as few as 4, as few as 3, as few as 2, or as few as 1 amino acid residue. In specific embodiments, the polypeptides can comprise an N-terminal or a C-terminal truncation, which can comprise at least a deletion of 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000, 1050 amino acids or more from either the N or C terminus of the polypeptide.

In certain embodiments, the presently disclosed polynucleotides comprise or encode a CRISPR repeat comprising a nucleotide sequence having at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to the nucleotide sequence set forth as SEQ ID NOs: 2, 17, 25, 36, 44, 51, or 63.

The presently disclosed polynucleotides can comprise or encode a tracrRNA comprising a nucleotide sequence having at least 40%, 45%, 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or greater identity to the nucleotide sequence set forth as SEQ ID NOs: 3, 18, 26, 37, 45, 52, or 62.

Biologically active variants of a CRISPR repeat or tracrRNA of the invention may differ by as few as about 1-25 nucleotides, as few as about 1-20, as few as about 1-10, as few as about 6-10, as few as 5, as few as 4, as few as 3, as few as 2, or as few as 1 nucleotide. In some embodiments, the polynucleotides can comprise a 5' or 3' truncation, which can comprise at least a deletion of 10, 15, 20, 25, 30, 35, 40, 45, 50, 55, 60, 65, 70, 75, 80 nucleotides or more from either the 5' or 3' end of the polynucleotide. In some embodiments, a CRISPR repeat or a tracrRNA may be altered by both deletion and/or insertion and also by mutation or substitution of nucleotides.

It is recognized that modifications may be made to the RGN polypeptides, DNA-binding polypeptide-deaminase fusion polypeptides, deaminase polypeptides, CRISPR repeats, and tracrRNAs provided herein creating variant proteins and polynucleotides. Changes designed by man may be introduced through the application of site-directed mutagenesis techniques. Alternatively, native, as yet-unknown or as yet unidentified polynucleotides and/or polypeptides structurally and/or functionally-related to the sequences disclosed herein may also be identified that fall within the scope of the present invention. Conservative amino acid substitutions may be made in nonconserved regions that do not alter the function of the RGN or deaminase proteins. Alternatively, modifications may be made that improve or alter the activity of the RGN or deaminase.

Variant polynucleotides and proteins also encompass sequences and proteins derived from a mutagenic and recombinogenic procedure such as DNA shuffling. With such a procedure, one or more different RGN or deaminase proteins disclosed herein (e.g., SEQ ID NOs: 1, 16, 24, 35, 43, 50, 374-545, and 572-584) is manipulated to create a new RGN or deaminase protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the RGN sequences provided herein and other known RGN genes to obtain a new gene coding for a protein with an improved property of interest, such as an increased $K_m$ in the case of an enzyme. The deaminases provided herein may also be shuffled in a similar strategy. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458. A "shuffled" nucleic acid is a nucleic acid produced by a shuffling procedure such as any shuffling procedure set forth herein. Shuffled nucleic acids are produced by recombining (physically or virtually) two or more nucleic acids (or character strings), for example in an artificial, and optionally recursive, fashion. Generally, one or more screening steps are used in shuffling processes to identify nucleic acids of interest; this screening step can be performed before or after any recombination step. In some (but not all) shuffling embodiments, it is desirable to perform multiple rounds of recombination prior to selection to increase the diversity of the pool to be screened. The overall process of recombination and selection are optionally repeated recursively. Depending on context, shuffling can refer to an overall process of recombination and selection, or, alternately, can simply refer to the recombinational portions of the overall process.

As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically, this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, California).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art and described, e.g., in Dayhoff et al. (1978) "A model of evolutionary change in proteins." In "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) *Proc. Natl. Acad. Sci. USA* 89:10915-10919. The BLOSUM62 matrix is often used as a default scoring substitution matrix in sequence alignment protocols. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al. (1997) *Nucleic Acids Res.* 25:3389-3402, and made available to the public at the National Center for Biotechnology Information Website (World Wide Web at ncbi.nlm.nih.gov). Optimal alignments, including multiple alignments, can be prepared using, e.g., PSI-BLAST, available through www.ncbi.nlm-.nih.gov and described by Altschul et al. (1997) *Nucleic Acids Res.* 25:3389-3402.

With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. Owing to deletions, insertion, truncations, fusions, etc., that must be taken into account when determining an optimal alignment, in general the amino acid residue number in a test sequence as determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

VI. Antibodies

Antibodies to the RGN polypeptides, ribonucleoproteins comprising the RGN polypeptides of the present invention, deaminases, or DNA-binding deaminase fusion proteins, including those comprising the amino acid sequence set forth as SEQ ID NOs: 1, 16, 24, 35, 43, 50, 374-545, and 572-584, or active variants or fragments thereof, are also encompassed. Methods for producing antibodies are well known in the art (see, for example, Harlow and Lane (1988) Antibodies: A Laboratory Manual, Cold Spring Harbor Laboratory, Cold Spring Harbor, N.Y.; and U.S. Pat. No. 4,196,265). These antibodies can be used in kits for the detection and isolation of RGN polypeptides or ribonucleoproteins. Thus, this disclosure provides kits comprising antibodies that specifically bind to the polypeptides or ribonucleoproteins described herein, including, for example, polypeptides having the sequence of any one of SEQ ID NOs: 1, 16, 24, 35, 43, 50, 374-545, and 572-584.

VII. Systems and Ribonucleoprotein Complexes for Binding a Target Sequence of Interest and Methods of Making the Same The present disclosure provides a system for binding a target sequence of interest, wherein the system comprises at least one guide RNA or a nucleotide sequence encoding the same, and at least one RNA-guided nuclease or a nucleotide sequence encoding the same. The guide RNA hybridizes to the target sequence of interest and also forms a complex with the RGN polypeptide, thereby directing the RGN polypeptide to bind to the target sequence. In some of these embodiments, the RGN comprises an amino acid sequence of SEQ ID NOs: 1, 16, 24, 35, 43, or 50, or an active variant or fragment thereof. In various embodiments, the guide RNA comprises a CRISPR repeat sequence comprising the nucleotide sequence of SEQ ID NOs: 2, 17, 25, 36, 44, 51, or 63, or an active variant or fragment thereof. In particular embodiments, the guide RNA comprises a tracrRNA comprising a nucleotide sequence of SEQ ID NOs: 3, 18, 26, 37, 45, 52, or 62, or an active variant or fragment thereof. The guide RNA of the system can be a single guide RNA or a dual-guide RNA. In particular embodiments, the system comprises a RNA-guided nuclease that is heterologous to the guideRNA, wherein the RGN and guideRNA are not naturally complexed in nature.

The present disclosure also provides a system which targets to a nucleic acid sequence and modifies the target nucleic acid sequence. The RNA-guided, DNA-binding polypeptide, such as an RGN, and the gRNA are responsible for targeting the ribonucleopolypeptide complex to a nucleic acid sequence of interest; the deaminase polypeptide is responsible for modifying the targeted nucleic acid sequence. The guide RNA hybridizes to the target sequence of interest and also forms a complex with the RNA-guided, DNA-binding polypeptide, thereby directing the RNA-guided, DNA-binding polypeptide to bind to the target sequence. The RNA-guided, DNA-binding polypeptide is one domain of a fusion protein; the other domain is a deaminase described herein. In some embodiments, the RNA-guided, DNA-binding polypeptide is an RGN, such as a Cas9. In further embodiments, the RNA-guided, DNA-binding polypeptide comprises an amino acid sequence of SEQ ID NO: 568, 569, 547, 553, or an active variant or fragment thereof. Other examples of RNA-guided, DNA-binding polypeptides include RGNs such as those described in U.S. patent application Ser. No. 16/432,321 (herein incorporated in its entirety by reference). In some embodiments, the RNA-guided, DNA-binding polypeptide is a Type II CRISPR-Cas polypeptide, or an active variant or fragment thereof. In some embodiments, the RNA-guided, DNA-binding polypeptide is a Type V CRISPR-Cas polypeptide, or an active variant or fragment thereof. In other embodiments, the RNA-guided, DNA-binding polypeptide is a Type VI CRISPR-Cas polypeptide. In other embodiments, the DNA-binding domain of the fusion protein does not require an RNA guide, such as a Zn finger nuclease, TALEN, or meganuclease polypeptide, wherein the nuclease activity of each has been inactivated.

The system for binding a target sequence of interest provided herein can be a ribonucleoprotein complex, which is at least one molecule of an RNA bound to at least one protein. In some embodiments, the ribonucleoprotein complexes provided herein comprise at least one guide RNA as the RNA component and an RNA-guided nuclease as the protein component. Such ribonucleoprotein complexes can be purified from a cell or organism that naturally expresses an RGN polypeptide and has been engineered to express a particular guide RNA that is specific for a target sequence of interest. In other embodiments, the ribonucleoprotein complexes provided herein comprise at least one guide RNA as the RNA component and a fusion protein comprising a deaminase of the invention and an RNA-guided, DNA-binding polypeptide as the protein component. In the case of fusion proteins, or in the case of an RGN of the invention, the ribonucleoprotein complex can be purified from a cell or organism that has been transformed with polynucleotides that encode the fusion protein (or an RGN of the invention alone) and a guide RNA and cultured under conditions to allow for the expression of the fusion protein (or an RGN of the invention alone) and guide RNA. Thus, methods are provided for making an RGN of the invention, a deaminase of the invention, a ribonucleoprotein complex comprising an RGN of the invention, a fusion protein of the invention, or a fusion protein ribonucleoprotein complex. Such methods comprise culturing a cell comprising a nucleotide sequence encoding a polypeptide of the invention, and in some embodiments a nucleotide sequence encoding a guide RNA, under conditions in which the polypeptide (and in some embodiments, the guide RNA) is expressed. The RGN of the invention, a ribonucleoprotein complex comprising an RGN of the invention, a fusion protein of the invention, or a fusion protein ribonucleoprotein complex can then be purified from a lysate of the cultured cells.

Methods for purifying an RGN of the invention, a deaminase of the invention, a ribonucleoprotein complex comprising an RGN of the invention, a fusion protein of the invention, or a fusion protein ribonucleoprotein complex from a lysate of a biological sample are known in the art (e.g., size exclusion and/or affinity chromatography, 2D-PAGE, HPLC, reversed-phase chromatography, immunoprecipitation). In particular methods, the polypeptide of the invention is recombinantly produced and comprises a purification tag to aid in its purification, including but not limited to, glutathione-S-transferase (GST), chitin binding protein (CBP), maltose binding protein, thioredoxin (TRX), poly(NANP), tandem affinity purification (TAP) tag, myc, AcV5, AU1, AU5, E, ECS, E2, FLAG, HA, nus, Softag 1, Softag 3, Strep, SBP, Glu-Glu, HSV, KT3, S, 51, T7, V5, VSV-G, 6×His (SEQ ID NO: 593), 10×His (SEQ ID NO: 594), biotin carboxyl carrier protein (BCCP), and calmodulin. Generally, the tagged polypeptide or ribonucleoprotein complex of the invention is purified using immobilized metal affinity chromatography. It will be appreciated that other similar methods known in the art may be used, including other forms of chromatography or for example immunoprecipitation, either alone or in combination.

An "isolated" or "purified" polypeptide, or biologically active portion thereof, is substantially or essentially free from components that normally accompany or interact with the polypeptide as found in its naturally occurring environment. Thus, an isolated or purified polypeptide is substantially free of other cellular material, or culture medium when produced by recombinant techniques, or substantially free of chemical precursors or other chemicals when chemically synthesized. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

Particular methods provided herein for binding and/or cleaving a target sequence of interest involve the use of an in vitro assembled RGN ribonucleoprotein complex. In vitro assembly of an RGN ribonucleoprotein complex can be performed using any method known in the art in which an RGN polypeptide is contacted with a guide RNA under conditions to allow for binding of the RGN polypeptide to the guide RNA. As used herein, "contact", "contacting", "contacted," refer to placing the components of a desired reaction together under conditions suitable for carrying out the desired reaction. The RGN polypeptide can be purified from a biological sample, cell lysate, or culture medium, produced via in vitro translation, or chemically synthesized. The guide RNA can be purified from a biological sample, cell lysate, or culture medium, transcribed in vitro, or chemically synthesized. The RGN polypeptide and guide RNA can be brought into contact in solution (e.g., buffered saline solution) to allow for in vitro assembly of the RGN ribonucleoprotein complex.

VIII. Methods of Binding, Cleaving, or Modifying a Target Sequence

The present disclosure provides methods for binding, cleaving, and/or modifying a target nucleotide sequence of interest. In some embodiments, the methods include delivering a system comprising at least one guide RNA or a polynucleotide encoding the same, and at least one RGN polypeptide or a polynucleotide encoding the same to the target sequence or a cell, organelle, or embryo comprising the target sequence. In some of these embodiments, the RGN comprises the amino acid sequence of SEQ ID NOs: 1, 16, 24, 35, 43, or 50, or an active variant or fragment thereof. In various embodiments, the guide RNA comprises a CRISPR repeat sequence comprising the nucleotide sequence of SEQ ID NOs: 2, 17, 25, 36, 44, 51, or 63, or an active variant or fragment thereof. In particular embodiments, the guide RNA comprises a tracrRNA comprising the nucleotide sequence of SEQ ID NOs: 3, 18, 26, 37, 45, 52, or 62, or an active variant or fragment thereof. The guide RNA of the system can be a single guide RNA or a dual-guide RNA. The RGN of the system may be nuclease dead RGN, have nickase activity, or may be a fusion polypeptide. In some embodiments, the fusion polypeptide comprises a base-editing polypeptide, for example a cytidine deaminase or an adenosine deaminase. In particular embodiments, the RGN and/or guide RNA is heterologous to the cell, organelle, or embryo to which the RGN and/or guide RNA (or polynucleotide(s) encoding at least one of the RGN and guide RNA) are introduced.

In other embodiments, the methods include delivering a system comprising at least one guide RNA or a polynucleotide encoding the same, and at least one fusion protein comprising a deaminase of the invention and an RNA-guided, DNA-binding polypeptide or a polynucleotide encoding the same to the target sequence or a cell, organelle, or embryo comprising the target sequence. In some of these embodiments, the fusion protein comprises any one of the amino acid sequences of SEQ ID NO: 374-545 or 572-584, or an active variant or fragment thereof.

In some embodiments, the methods comprise contacting a target polynucleotide with a deaminase disclosed herein. In some embodiments, the methods comprise contacting a target polynucleotide with a fusion protein comprising a deaminase domain and DNA-binding domain. In some of these embodiments, the methods comprise contacting a DNA molecule with (a) a fusion protein comprising a deaminase domain and a RNA-guided, DNA-binding polypeptide, such as for example a nuclease-inactive RGN domain; and (b) a gRNA targeting the fusion protein of (a) to a target nucleotide sequence of the DNA strand; wherein the DNA molecule is contacted with the fusion protein and the gRNA in an amount effective and under conditions suitable for the deamination of a nucleotide base. In some of those embodiments wherein a deaminase is utilized in the method, the deaminase has the amino acid sequence of any one of SEQ ID NOs: 374, 383, 397, 399, 407, 408, 411, 414, 416, 420, 514, and 572-584 or is a variant thereof, wherein the variant has an amino acid sequence of at least 50%, at least 55%, at least 60%, at least 65%, at least 70%, at least 75%, at least 80%, at least 85%, at least 90%, at least 95%, at least 96%, at least 97%, at least 98%, or at least 99% identity to the amino acid sequence of any of SEQ ID NOs: 374, 383, 397, 399, 407, 408, 411, 414, 416, 420, 514, and 572-584. In some of these embodiments, the variant deaminase polypeptide has a certain level of sequence identity to any one of SEQ ID NOs: 572-584, wherein specific amino acid residues are unchanged from the parent sequence. For example, in some embodiments, a variant SEQ ID NO: 572 comprises a lysine at a position corresponding to position 102, a tyrosine at a position corresponding to position 104, and a threonine at a position corresponding to position 106 of SEQ ID NO: 572. In particular embodiments, a variant SEQ ID NO: 574 comprises a glutamic acid at a position corresponding to position 101, a serine at a position corresponding to position 103, and a lysine at a position corresponding to position 105 of SEQ ID NO: 574. In certain embodiments, a variant SEQ ID NO: 575 comprises a lysine at a position corresponding to position 101, a leucine at a position corresponding to position 103, and a glutamic acid at a position corresponding to position 105 of SEQ ID NO: 575. In some embodiments, a variant SEQ ID NO: 576 comprises an alanine at a position corresponding to position 105 and an arginine at a position corresponding to position 107 of SEQ ID NO: 576. In particular embodiments, a variant SEQ ID NO: 577 comprises a glycine at a position corresponding to position 102, a serine at a position corresponding to position 104, and an arginine at a position corresponding to position 106 of SEQ ID NO: 577. In certain embodiments, a variant SEQ ID NO: 578 comprises a serine at a position corresponding to position 105 and a threonine at a position corresponding to position 107 of SEQ ID NO: 578. In some embodiments, a variant SEQ ID NO: 579 comprises a serine at a position corresponding to position 102, a glutamine at a position corresponding to position 104, and a glycine at a position corresponding to position 106 of SEQ ID NO: 579. In particular embodiments, a variant SEQ ID NO: 580 comprises a glycine at a position corresponding to position 111 of SEQ ID NO: 580. In some embodiments, a variant SEQ ID NO: 581 comprises a glutamine at a position corresponding to position 104, a glycine at a position corresponding to position 106, and a glutamic acid at a position corresponding to position 108 of SEQ ID NO: 581. In certain embodiments, a variant SEQ ID NO: 582 comprises an arginine at a position corresponding to position 102, a tryptophan at a position corresponding to position 104, and a glutamic acid at a position corresponding to position 106 of SEQ ID NO: 582. In certain embodiments, a variant SEQ ID NO: 583 comprises an arginine at a position corresponding to position 104 and a serine at a position corresponding to position 106 of SEQ ID NO: 583. In particular embodiments, a variant SEQ ID NO: 584 comprises a phenylalanine at a position corresponding to position 110, a serine at a position corresponding to position 112, and a threonine at a position corresponding to position 114 of SEQ ID NO: 584.

In some embodiments, the methods comprise contacting a DNA molecule with (a) a fusion protein comprising a deaminase domain and a RNA-guided, DNA-binding polypeptide, such as for example a nuclease-inactive RGN domain; and (b) a gRNA targeting the fusion protein of (a) to a target nucleotide sequence of the DNA strand; wherein the DNA molecule is contacted with the fusion protein and the gRNA in an amount effective and under conditions suitable for the deamination of a nucleotide base. In some embodiments, the target DNA sequence comprises a sequence associated with a disease or disorder, and wherein the deamination of the nucleotide base results in a sequence that is not associated with a disease or disorder. In some embodiments, the target DNA sequence resides in an allele of a crop plant, wherein the particular allele of the trait of interest results in a plant of lesser agronomic value. The deamination of the nucleotide base results in an allele that improves the trait and increases the agronomic value of the plant.

In some embodiments, the DNA sequence comprises a T→C or A→G point mutation associated with a disease or disorder, and wherein the deamination of the mutant C or G base results in a sequence that is not associated with a disease or disorder. In some embodiments, the deamination corrects a point mutation in the sequence associated with the disease or disorder.

In some embodiments, the sequence associated with the disease or disorder encodes a protein, and wherein the deamination introduces a stop codon into the sequence associated with the disease or disorder, resulting in a truncation of the encoded protein. In some embodiments, the contacting is performed in vivo in a subject susceptible to having, having, or diagnosed with the disease or disorder. In some embodiments, the disease or disorder is a disease associated with a point mutation, or a single-base mutation, in the genome. In some embodiments, the disease is a genetic disease, a cancer, a metabolic disease, or a lysosomal storage disease.

In those embodiments wherein the method comprises delivering a polynucleotide encoding a guide RNA and/or an RGN polypeptide or a fusion polypeptide comprising a deaminase of the invention and an RNA-guided, DNA-binding polypeptide, the cell or embryo can then be cultured under conditions in which the guide RNA and/or RGN polypeptide are expressed. In various embodiments, the method comprises contacting a target sequence with an RGN ribonucleoprotein complex. The RGN ribonucleoprotein complex may comprise an RGN that is nuclease dead or has nickase activity. In some embodiments, the RGN of the ribonucleoprotein complex is a fusion polypeptide comprising a base-editing polypeptide, such as for example a deaminase disclosed herein. In other embodiments, the ribonucleoprotein complex comprises a fusion polypeptide comprising a deaminase of the invention and an RNA-guided, DNA-binding polypeptide. In certain embodiments, the method comprises introducing into a cell, organelle, or embryo comprising a target sequence an RGN ribonucleoprotein complex. The RGN ribonucleoprotein complex can be one that has been purified from a biological sample, recombinantly produced and subsequently purified, or in vitro-assembled as described herein. In those embodiments wherein the RGN ribonucleoprotein complex that is contacted with the target sequence or a cell organelle, or embryo has been assembled in vitro, the method can further comprise the in vitro assembly of the complex prior to contact with the target sequence, cell, organelle, or embryo.

A purified or in vitro assembled RGN ribonucleoprotein complex can be introduced into a cell, organelle, or embryo using any method known in the art, including, but not limited to electroporation. Alternatively, an RGN polypeptide, a fusion polypeptide comprising a deaminase of the invention and an RNA-guided, DNA-binding polypeptide, and/or polynucleotide encoding or comprising the guide RNA can be introduced into a cell, organelle, or embryo using any method known in the art (e.g., electroporation).

Upon delivery to or contact with the target sequence or cell, organelle, or embryo comprising the target sequence, the guide RNA directs the RGN polypeptide or the fusion polypeptide to bind to the target sequence in a sequence-specific manner. In those embodiments wherein the RGN has nuclease activity, the RGN polypeptide cleaves the target sequence of interest upon binding. The target sequence can subsequently be modified via endogenous repair mechanisms, such as non-homologous end joining, or homology-directed repair with a provided donor polynucleotide.

Methods to measure binding of an RNA-guided, DNA-binding polypeptide to a target sequence are known in the art and include chromatin immunoprecipitation assays, gel mobility shift assays, DNA pull-down assays, reporter assays, microplate capture and detection assays. Likewise, methods to measure cleavage or modification of a target sequence are known in the art and include in vitro or in vivo cleavage assays wherein cleavage is confirmed using PCR, sequencing, or gel electrophoresis, with or without the attachment of an appropriate label (e.g., radioisotope, fluorescent substance) to the target sequence to facilitate detection of degradation products. Alternatively, the nicking triggered exponential amplification reaction (NTEXPAR) assay can be used (see, e.g., Zhang et al. (2016) *Chem. Sci.* 7:4951-4957). In vivo cleavage can be evaluated using the Surveyor assay (Guschin et al. (2010) *Methods Mol Biol* 649:247-256).

In some embodiments, the methods involve the use of a single type of RGN complexed with more than one guide RNA. The more than one guide RNA can target different regions of a single gene or can target multiple genes. In other embodiments, the methods involve the use of a single type of RNA-binding, DNA-guided domain, as part of the fusion protein, complexed with more than one guide RNA. This multiple targeting enables the deaminase domain of the fusion protein to modify nucleic acids, thereby introducing multiple mutations in the genome of interest.

In those embodiments wherein a donor polynucleotide is not provided, a double-stranded break introduced by an RGN polypeptide can be repaired by a non-homologous end-joining (NHEJ) repair process. Due to the error-prone nature of NHEJ, repair of the double-stranded break can result in a modification to the target sequence. As used herein, a "modification" in reference to a nucleic acid molecule refers to a change in the nucleotide sequence of the nucleic acid molecule, which can be a deletion, insertion, or substitution of one or more nucleotides, or a combination thereof. Modification of the target sequence can result in the expression of an altered protein product or inactivation of a coding sequence.

In those embodiments wherein a donor polynucleotide is present, the donor sequence in the donor polynucleotide can be integrated into or exchanged with the target nucleotide sequence during the course of repair of the introduced double-stranded break, resulting in the introduction of the exogenous donor sequence. A donor polynucleotide thus comprises a donor sequence that is desired to be introduced into a target sequence of interest. In some embodiments, the donor sequence alters the original target nucleotide sequence such that the newly integrated donor sequence will not be recognized and cleaved by the RGN. Integration of the donor sequence can be enhanced by the inclusion within the donor polynucleotide of flanking sequences that have substantial sequence identity with the sequences flanking the target nucleotide sequence, allowing for a homology-directed repair process. In those embodiments wherein the RGN polypeptide introduces double-stranded staggered breaks, the donor polynucleotide can comprise a donor sequence flanked by compatible overhangs, allowing for direct ligation of the donor sequence to the cleaved target nucleotide sequence comprising overhangs by a non-homologous repair process during repair of the double-stranded break.

In those embodiments wherein the method involves the use of an RGN of the invention that is a nickase (i.e., is only able to cleave a single strand of a double-stranded polynucleotide), the method can comprise introducing two RGN nickases that target identical or overlapping target sequences and cleave different strands of the polynucleotide. For example, an RGN nickase that only cleaves the positive (+) strand of a double-stranded polynucleotide can be introduced along with a second RGN nickase that only cleaves the negative (−) strand of a double-stranded polynucleotide. Similarly, in some embodiments, the method involves the use of a fusion polypeptide comprising a deaminase of the invention and an RNA-guided, DNA-binding polypeptide, such as for example and RGN, wherein the RGN is a nickase (for example SEQ ID NO: 569).

In various embodiments, a method is provided for binding a target nucleotide sequence and detecting the target sequence, wherein the method comprises introducing into a cell, organelle, or embryo at least one guide RNA or a polynucleotide encoding the same, and at least one RGN polypeptide or a polynucleotide encoding the same, expressing the guide RNA and/or RGN polypeptide (if coding sequences are introduced), wherein the RGN polypeptide is a nuclease-dead RGN and further comprises a detectable label, and the method further comprises detecting the detectable label. The detectable label may be fused to the RGN as a fusion protein (e.g., fluorescent protein) or may be a small molecule conjugated to or incorporated within the RGN polypeptide that can be detected visually or by other means.

Also provided herein are methods for modulating the expression of a target sequence or a gene of interest under the regulation of a target sequence. The methods comprise introducing into a cell, organelle, or embryo at least one guide RNA or a polynucleotide encoding the same, and at least one RGN polypeptide or a polynucleotide encoding the same, expressing the guide RNA and/or RGN polypeptide (if coding sequences are introduced), wherein the RGN polypeptide is a nuclease-dead RGN. In some of these embodiments, the nuclease-dead RGN is a fusion protein comprising an expression modulator domain (i.e., epigenetic modification domain, transcriptional activation domain or a transcriptional repressor domain) as described herein. In some embodiments, the nuclease-dead RGN is a fusion protein comprising a deaminase described herein.

The present disclosure also provides methods for binding and/or modifying a target nucleotide sequence of interest. The methods include delivering a system comprising at least one guide RNA or a polynucleotide encoding the same, and at least one fusion polypeptide comprises an RGN of the invention and a base-editing polypeptide, for example a deaminase described herein, or a polynucleotide encoding the fusion polypeptide, to the target sequence or a cell, organelle, or embryo comprising the target sequence.

One of ordinary skill in the art will appreciate that any of the presently disclosed methods can be used to target a single target sequence or multiple target sequences. Thus, methods comprise the use of a single RGN polypeptide in combination with multiple, distinct guide RNAs, which can target multiple, distinct sequences within a single gene and/or multiple genes. Also encompassed herein are methods wherein multiple, distinct guide RNAs are introduced in combination with multiple, distinct RGN polypeptides. These guide RNAs and guide RNA/RGN polypeptide systems can target multiple, distinct sequences within a single gene and/or multiple genes.

In one aspect, the invention provides kits containing any one or more of the elements disclosed in the above methods and compositions. In some embodiments, the kit comprises a vector system and instructions for using the kit. In some embodiments, the vector system comprises (a) a first regulatory element operably linked to a tracr mate sequence and one or more insertion sites for inserting a guide sequence upstream of the tracr mate sequence, wherein when expressed, the guide sequence directs sequence-specific binding of a CRISPR complex to a target sequence in a eukaryotic cell, wherein the CRISPR complex comprises a CRIS PR enzyme complexed with (1) the guide sequence that is hybridized to the target sequence, and (2) the tracr mate sequence that is hybridized to the tracr sequence; and/or (b) a second regulatory element operably linked to an enzyme coding sequence encoding said CRISPR enzyme comprising a nuclear localization sequence.

In some embodiments, the kit comprises a fusion protein comprising an RNA-guided, DNA-binding polypeptide, such as an RGN polypeptide, for example a nuclease-inactive Cas9 domain, and a deaminase of the invention, and, optionally, a linker positioned between the Cas9 domain and the deaminase. In addition, in some embodiments, the kit comprises suitable reagents, buffers, and/or instructions for using the fusion protein, e.g., for in vitro or in vivo DNA or RNA editing. Elements may be provided individually or in combinations, and may be provided in any suitable container, such as a vial, a bottle, or a tube. In some embodiments, the kit comprises instructions regarding the design and use of suitable gRNAs for targeted editing of a nucleic acid sequence.

In some embodiments, the kit includes instructions in one or more languages. In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10.

In some embodiments, the kit comprises one or more oligonucleotides corresponding to a guide sequence for insertion into a vector so as to operably link the guide sequence and a regulatory element. In some embodiments, the kit comprises a homologous recombination template polynucleotide. In one aspect, the invention provides methods for using one or more elements of a CRISPR system. The CRISPR complex of the invention provides an effective means for modifying a target polynucleotide. The CRISPR complex of the invention has a wide variety of utility including modifying (e.g., deleting, inserting, translocating, inactivating, activating) a target polynucleotide in a multiplicity of cell types. As such the CRISPR complex of the invention has a broad spectrum of applications in, e.g., gene therapy, drug screening, disease diagnosis, and prognosis. An exemplary CRISPR complex comprises a CRISPR enzyme complexed with a guide sequence hybridized to a target sequence within the target polynucleotide.

VIII. Target Polynucleotides

In one aspect, the invention provides for methods of modifying a target polynucleotide in a eukaryotic cell, which may be in vivo, ex vivo or in vitro. In some embodiments, the method comprises sampling a cell or population of cells from a human or non-human animal or plant (including microalgae) and modifying the cell or cells. Culturing may occur at any stage ex vivo. The cell or cells may even be re-introduced into the non-human animal or plant (including micro-algae).

Using natural variability, plant breeders combine most useful genes for desirable qualities, such as yield, quality, uniformity, hardiness, and resistance against pests. These desirable qualities also include growth, day length preferences, temperature requirements, initiation date of floral or reproductive development, fatty acid content, insect resistance, disease resistance, nematode resistance, fungal resistance, herbicide resistance, tolerance to various environmental factors including drought, heat, wet, cold, wind, and adverse soil conditions including high salinity The sources of these useful genes include native or foreign varieties, heirloom varieties, wild plant relatives, and induced mutations, e.g., treating plant material with mutagenic agents. Using the present invention, plant breeders are provided with a new tool to induce mutations. Accordingly, one skilled in the art can analyze the genome for sources of useful genes, and in varieties having desired characteristics or traits employ the present invention to induce the rise of useful genes, with more precision than previous mutagenic agents and hence accelerate and improve plant breeding programs.

The target polynucleotide of an RGN system can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence).

The target polynucleotide of a CRISPR complex may include a number of disease-associated genes and polynucleotides as well as signaling biochemical pathway-associated genes and polynucleotides. Examples of target polynucleotides include a sequence associated with a signaling biochemical pathway, e.g., a signaling biochemical pathway-associated gene or polynucleotide. Examples of target polynucleotides include a disease associated gene or poly-nucleotide. A "disease-associated" gene or polynucleotide refers to any gene or polynucleotide which is yielding transcription or translation products at an abnormal level or in an abnormal form in cells derived from a disease-affected tissues compared with tissues or cells of a non-disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease (e.g., a causal mutation). The transcribed or translated products may be known or unknown, and further may be at a normal or abnormal level. Examples of disease-associated genes and polynucleotides are available from McKusick-Nathans Institute of Genetic Medicine, Johns Hopkins University (Baltimore, Md.) and National Center for Biotechnology Information, National Library of Medicine (Bethesda, Md.), available on the World Wide Web.

Although CRISPR systems are particularly useful for their relative ease in targeting to genomic sequences of interest, there still remains an issue of what the RGN can do to address a causal mutation. One approach is to produce a fusion protein between an RGN (preferably an inactive or nickase variant of the RGN) and a base-editing enzyme or the active domain of a base editing enzyme, such as a cytidine deaminase or an adenosine deaminase base editor (U.S. Pat. No. 9,840,699, herein incorporated by reference). In some embodiments, the methods comprise contacting a DNA molecule with (a) a fusion protein comprising an RGN of the invention and a base-editing polypeptide such as a deaminase; and (b) a gRNA targeting the fusion protein of (a) to a target nucleotide sequence of the DNA strand; wherein the DNA molecule is contacted with the fusion protein and the gRNA in an amount effective and under conditions suitable for the deamination of a nucleotide base. In some embodiments, the target DNA sequence comprises a sequence associated with a disease or disorder, and wherein the deamination of the nucleotide base results in a sequence that is not associated with a disease or disorder. In some embodiments, the target DNA sequence resides in an allele of a crop plant, wherein the particular allele of the trait of interest results in a plant of lesser agronomic value. The deamination of the nucleotide base results in an allele that improves the trait and increases the agronomic value of the plant.

In some embodiments, the DNA sequence comprises a T→C or A→G point mutation associated with a disease or disorder, and wherein the deamination of the mutant C or G base results in a sequence that is not associated with a disease or disorder. In some embodiments, the deamination corrects a point mutation in the sequence associated with the disease or disorder.

In some embodiments, the sequence associated with the disease or disorder encodes a protein, and wherein the deamination introduces a stop codon into the sequence associated with the disease or disorder, resulting in a truncation of the encoded protein. In some embodiments, the contacting is performed in vivo in a subject susceptible to having, having, or diagnosed with the disease or disorder. In some embodiments, the disease or disorder is a disease associated with a point mutation, or a single-base mutation, in the genome. In some embodiments, the disease is a genetic disease, a cancer, a metabolic disease, or a lysosomal storage disease.

Further examples of loci which are causal for certain genetic diseases, particularly loci which can be readily targeted by RGNs or RGN-base editor fusion proteins of the invention, can be found in Example 7 and corresponding Table 8.

Hurler Syndrome

An example of a genetically inherited disease which could be corrected using an approach that relies on an RGN-base editor fusion protein of the invention is Hurler Syndrome. Hurler Syndrome, also known as MPS-1, is the result of a deficiency of α-L-iduronidase (IDUA) resulting in a lyso-somal storage disease characterized at the molecular level by the accumulation of dermatan sulfate and heparan sulfate in lysosomes. This disease is generally an inherited genetic disorder caused by mutations in the IDUA gene encoding α-L-iduronidase. Common IDUA mutations are W402X and Q70X, both nonsense mutations resulting in premature termination of translation. Such mutations are well addressed by precise genome editing (PGE) approaches, since reversion of a single nucleotide, for example by a base-editing approach, would restore the wild-type coding sequence and result in protein expression controlled by the endogenous regulatory mechanisms of the genetic locus. Additionally, since heterozygotes are known to be asymp-tomatic, a PGE therapy that targets one of these mutations would be useful to a large proportion of patients with this disease, as only one of the mutated alleles needs to be corrected (Bunge et al. (1994) Hum. Mol. Genet. 3(6): 861-866, herein incorporated by reference).

Current treatments for Hurler Syndrome include enzyme replacement therapy and bone marrow transplants (Vellodi et al. (1997) Arch. Dis. Child. 76(2): 92-99; Peters et al. (1998) Blood 91(7): 2601-2608, herein incorporated by reference). While enzyme replacement therapy has had a dramatic effect on the survival and quality of life of Hurler Syndrome patients, this approach requires costly and time-consuming weekly infusions. Additional approaches include the delivery of the IDUA gene on an expression vector or the insertion of the gene into a highly expressed locus such as that of serum albumin (U.S. Pat. No. 9,956,247, herein incorporated by reference). However, these approaches do not restore the original IDUA locus to the correct coding sequence. A genome-editing strategy would have a number of advantages, most notably that regulation of gene expres-sion would be controlled by the natural mechanisms present in healthy individuals. Additionally, using base editing does not necessitate causing a double stranded DNA breaks, which could lead to large chromosomal rearrangements, cell death, or oncogenecity by the disruption of tumor suppres-sion mechanisms. An enabling description of a method to correct the causal mutation of this disease is provided in Example 8. The described methods are an example of a general strategy directed toward using RGN-base editor fusion proteins of the invention to target and correct certain disease-causing mutations in the human genome. It will be appreciated that similar approaches to target diseases such as those described in Table 8 may also be pursued. It will be further appreciated that similar approaches to target disease-causing mutations in other species, particularly common household pets or livestock, can also be deployed using the RGNs of the invention. Common household pets and live-stock include dogs, cats, horses, pigs, cows, sheep, chickens, donkeys, snakes, ferrets, fish including salmon, and shrimp.

Friedreich's Ataxia

RGNs of the invention could also be useful in human therapeutic approaches where the causal mutation is more complicated. For example, some diseases such as Friedreich's Ataxia and Huntington's Disease are the result of a significant increase in repeats of a three nucleotide motif at a particular region of a gene, which affects the ability of the expressed protein to function or to be expressed. Friedreich's Ataxia (FRDA) is an autosomal recessive disease resulting in progressive degeneration of nervous tissue in the spinal cord. Reduced levels of the frataxin (FXN) protein in the mitochondria cause oxidative damages and iron deficiencies at the cellular level. The reduced FXN expression has been linked to a GAA triplet expansion within the intron 1 of the somatic and germline FXN gene. In FRDA patients, the GAA repeat frequently consists of more than 70, sometimes even more than 1000 (most commonly 600-900) triplets, whereas unaffected individuals have about 40 repeats or less (Pandolfo et al. (2012) Handbook of Clinical Neurology 103: 275-294; Campuzano et al. (1996) Science 271: 1423-1427; Pandolfo (2002) Adv. Exp. Med. Biol. 516: 99-118; all herein incorporated by reference).

The expansion of the trinucleotide repeat sequence causing Friedreich's Ataxia (FRDA) occurs in a defined genetic locus within the FXN gene, referred to as the FRDA instability region. RNA guided nucleases (RGNs) may be used for excising the instability region in FRDA patient cells. This approach requires 1) an RGN and guide RNA sequence that can be programmed to target the allele in the human genome; and 2) a delivery approach for the RGN and guide sequence. Many nucleases used for genome editing, such as the commonly used Cas9 nuclease from *S. pyogenes* (SpCas9), are too large to be packaged into adeno-associated viral (AAV) vectors, especially when considering the length of the SpCas9 gene and the guide RNA in addition to other genetic elements required for functional expression cassettes. This makes an approach using SpCas9 more difficult. The compact RNA guided nucleases of the invention are uniquely well suited for the excision of the FRDA instability region. Each RGN has a PAM requirement that is in the vicinity of the FRDA instability region. Additionally, each of these RGNs can be packaged into an AAV vector along with a guide RNA. Packing two guide RNAs may require a second vector, but this approach still compares favorably to what would be required of a larger nuclease such as SpCas9, which may require splitting the protein sequence between two vectors. An enabling description of a method to correct the causal mutation of this disease is provided in Example 9. The described methods encompass a strategy using RGNs of the invention in which a region of genomic instability is removed. Such a strategy is applicable to other diseases and disorders which have a similar genetic basis, such as Huntington's Disease. Similar strategies using RGNs of the invention may also be applicable to similar diseases and disorders in non-human animals of agronomic or economic importance, including dogs, cats, horses, pigs, cows, sheep, chickens, donkeys, snakes, ferrets, fish including salmon, and shrimp.

Hemoglobinopathies

RGNs of the invention could also be used to introduce disruptive mutations that may result in a beneficial effect. Genetic defects in the genes encoding hemoglobin, particularly the beta globin chain (the HBB gene), can be responsible for a number of diseases known as hemoglobinopathies, including sickle cell anemia and thalassemias.

In adult humans, hemoglobin is a heterotetramer comprising two alpha ($\alpha$)-like globin chains and two beta ($\beta$)-like globin chains and 4 heme groups. In adults the $\alpha 2\beta 2$ tetramer is referred to as Hemoglobin A (HbA) or adult hemoglobin. Typically, the alpha and beta globin chains are synthesized in an approximate 1:1 ratio and this ratio seems to be critical in terms of hemoglobin and red blood cell (RBC) stabilization. In a developing fetus, a different form of hemoglobin, fetal hemoglobin (HbF), is produced which has a higher binding affinity for oxygen than Hemoglobin A such that oxygen can be delivered to the baby's system via the mother's blood stream. Fetal hemoglobin also contains two a globin chains, but in place of the adult $\beta$-globin chains, it has two fetal gamma ($\gamma$)-globin chains (i.e., fetal hemoglobin is $\alpha 2\gamma 2$). The regulation of the switch from production of gamma- to beta-globin is quite complex, and primarily involves a down-regulation of gamma globin transcription with a simultaneous up-regulation of beta globin transcription. At approximately 30 weeks of gestation, the synthesis of gamma globin in the fetus starts to drop while the production of beta globin increases. By approximately 10 months of age, the newborn's hemoglobin is nearly all $\alpha 2\beta 2$ although some HbF persists into adulthood (approximately 1-3% of total hemoglobin). In the majority of patients with hemoglobinopathies, the genes encoding gamma globin remain present, but expression is relatively low due to normal gene repression occurring around parturition as described above.

Sickle cell disease is caused by a V6E mutation in the $\beta$ globin gene (HBB) (a GAG to GTG at the DNA level), where the resultant hemoglobin is referred to as "hemoglobinS" or "HbS." Under lower oxygen conditions, HbS molecules aggregate and form fibrous precipitates. These aggregates cause the abnormality or 'sickling' of the RBCs, resulting in a loss of flexibility of the cells. The sickling RBCs are no longer able to squeeze into the capillary beds and can result in vaso-occlusive crisis in sickle cell patients. In addition, sickled RBCs are more fragile than normal RBCs, and tend towards hemolysis, eventually leading to anemia in the patient.

Treatment and management of sickle cell patients is a life-long proposition involving antibiotic treatment, pain management and transfusions during acute episodes. One approach is the use of hydroxyurea, which exerts its effects in part by increasing the production of gamma globin. Long term side effects of chronic hydroxyurea therapy are still unknown, however, and treatment gives unwanted side effects and can have variable efficacy from patient to patient. Despite an increase in the efficacy of sickle cell treatments, the life expectancy of patients is still only in the mid to late 50's and the associated morbidities of the disease have a profound impact on a patient's quality of life.

Thalassemias (alpha thalassemias and beta thalassemia) are also diseases relating to hemoglobin and typically involve a reduced expression of globin chains. This can occur through mutations in the regulatory regions of the genes or from a mutation in a globin coding sequence that results in reduced expression or reduced levels or functional globin protein. Treatment of thalassemias usually involves blood transfusions and iron chelation therapy. Bone marrow transplants are also being used for treatment of people with severe thalassemias if an appropriate donor can be identified, but this procedure can have significant risks.

One approach that has been proposed for the treatment of both SCD and beta thalassemias is to increase the expression of gamma globin so that HbF functionally replaces the aberrant adult hemoglobin As mentioned above, treatment of SCD patients with hydroxyurea is thought to be successful in part due to its effect on increasing gamma globin expression (DeSimone (1982) Proc Nat'l Acad Sci USA 79(14):

55

56

4428-31; Ley, et al., (1982) N. Engl. J. Medicine, 307: 1469-1475; Ley, et al., (1983) Blood 62: 370-380; Constantoulakis et al., (1988) Blood 72(6):1961-1967, all herein incorporated by reference). Increasing the expression of HbF involves identification of genes whose products play a role in the regulation of gamma globin expression. One such gene is BCL11A. BCL11A encodes a zinc finger protein that expressed in adult erythroid precursor cells, and down-regulation of its expression leads to an increase in gamma globin expression (Sankaran et at (2008) Science 322: 1839, herein incorporated by reference). Use of an inhibitory RNA targeted to the BCL11A gene has been proposed (e.g., U.S. Patent Publication 2011/0182867, herein incorporated by reference) but this technology has several potential drawbacks, including that complete knock down may not be achieved, delivery of such RNAs may be problematic, and the RNAs must be present continuously, requiring multiple treatments for life.

RGNs of the invention may be used to target the BCL11A enhancer region to disrupt expression of BCL11A, thereby increasing gamma globin expression. This targeted disruption can be achieved by non-homologous end joining (NHEJ), whereby an RGN of the invention targets to a particular sequence within the BCL11A enhancer region, makes a double-stranded break, and the cell's machinery repairs the break, typically simultaneously introducing deleterious mutations. Similar to what is described for other disease targets, the RGNs of the invention have advantages over other known RGNs due to their relatively small size, which enables packaging expression cassettes for the RGN and its guide RNA into a single AAV vector for in vivo delivery. An enabling description of this method is provided in Example 10. Similar strategies using RGNs of the invention may also be applicable to similar diseases and disorders in both humans and in non-human animals of agronomic or economic importance.

IX. Cells Comprising a Polynucleotide Genetic Modification

Provided herein are cells and organisms comprising a target sequence of interest that has been modified using a process mediated by an RGN, crRNA, tracrRNA, and/or deaminase as described herein. In some of these embodiments, the RGN comprises the amino acid sequence of SEQ ID NOs: 1, 16, 24, 35, 43, or 50, or an active variant or fragment thereof. In various embodiments, the guide RNA comprises a CRISPR repeat sequence comprising the nucleotide sequence of SEQ ID NOs: 2, 17, 25, 36, 44, 51, or 63, or an active variant or fragment thereof. In particular embodiments, the guide RNA comprises a tracrRNA comprising the nucleotide sequence of SEQ ID NOs: 3, 18, 26, 37, 45, 52, or 62, or an active variant or fragment thereof. The guide RNA of the system can be a single guide RNA or a dual-guide RNA. In some embodiments, the deaminase comprises the amino acid sequence of any one of SEQ ID NOs: 374-545 and 572-584 or an active variant or fragment thereof.

The modified cells can be eukaryotic (e.g., mammalian, plant, insect cell) or prokaryotic. Also provided are organelles and embryos comprising at least one nucleotide sequence that has been modified by a process utilizing an RGN, crRNA, and/or tracrRNA as described herein. The genetically modified cells, organisms, organelles, and embryos can be heterozygous or homozygous for the modified nucleotide sequence.

The chromosomal modification of the cell, organism, organelle, or embryo can result in altered expression (up-regulation or down-regulation), inactivation, or the expression of an altered protein product or an integrated sequence. In those instances wherein the chromosomal modification results in either the inactivation of a gene or the expression of a non-functional protein product, the genetically modified cell, organism, organelle, or embryo is referred to as a "knock out". The knock out phenotype can be the result of a deletion mutation (i.e., deletion of at least one nucleotide), an insertion mutation (i.e., insertion of at least one nucleotide), or a nonsense mutation (i.e., substitution of at least one nucleotide such that a stop codon is introduced).

Alternatively, the chromosomal modification of a cell, organism, organelle, or embryo can produce a "knock in", which results from the chromosomal integration of a nucleotide sequence that encodes a protein. In some of these embodiments, the coding sequence is integrated into the chromosome such that the chromosomal sequence encoding the wild-type protein is inactivated, but the exogenously introduced protein is expressed.

In other embodiments, the chromosomal modification results in the production of a variant protein product. The expressed variant protein product can have at least one amino acid substitution and/or the addition or deletion of at least one amino acid. The variant protein product encoded by the altered chromosomal sequence can exhibit modified characteristics or activities when compared to the wild-type protein, including but not limited to altered enzymatic activity or substrate specificity.

In yet other embodiments, the chromosomal modification can result in an altered expression pattern of a protein. As a non-limiting example, chromosomal alterations in the regulatory regions controlling the expression of a protein product can result in the overexpression or downregulation of the protein product or an altered tissue or temporal expression pattern.

The article "a" and "an" are used herein to refer to one or more than one (i.e., to at least one) of the grammatical object of the article. By way of example, "a polypeptide" means one or more polypeptides.

All publications and patent applications mentioned in the specification are indicative of the level of those skilled in the art to which this disclosure pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended embodiments.

Non-Limiting Embodiments Include:

1. A nucleic acid molecule comprising a polynucleotide encoding an RNA-guided nuclease (RGN) polypeptide, wherein said polynucleotide comprises a nucleotide sequence encoding an RGN polypeptide comprising an amino acid sequence having at least 95% sequence identity to SEQ ID NOs: 1, 16, 24, 35, 43, or 50; wherein said RGN polypeptide binds a target DNA sequence in an RNA-guided sequence specific manner when bound to a guide RNA (gRNA) capable of hybridizing to said target DNA sequence, and wherein said polynucleotide encoding an RGN polypeptide is operably linked to a promoter heterologous to said polynucleotide.

2. The nucleic acid molecule of embodiment 1, wherein said RGN polypeptide is capable of cleaving said target DNA sequence upon binding.

3. The nucleic acid molecule of embodiment 2, wherein cleavage by said RGN polypeptide generates a double-stranded break.

4. The nucleic acid molecule of embodiment 2, wherein cleavage by said RGN polypeptide generates a single-stranded break.

5. The nucleic acid molecule of embodiment 1, wherein said RGN polypeptide is nuclease dead or functions as a nickase.

6. The nucleic acid molecule of embodiment 5, wherein the RGN polypeptide is operably fused to a base-editing polypeptide.

7. The nucleic acid molecule of embodiment 6, wherein said base-editing polypeptide is a deaminase.

8. The nucleic acid molecule of embodiment 7, wherein said deaminase has at least 90% sequence identity to any one of SEQ ID NOs: 374, 383, 397, 399, 407, 408, 411, 414, 416, 420, 514, and 572-584.

9. The nucleic acid molecule of any one of embodiments 1-8, wherein the RGN polypeptide comprises one or more nuclear localization signals.

10. The nucleic acid molecule of any one of embodiments 1-9, wherein the RGN polypeptide is codon optimized for expression in a eukaryotic cell.

11. The nucleic acid molecule of any one of embodiments 1-10, wherein said target DNA sequence is located adjacent to a protospacer adjacent motif (PAM).

12. A vector comprising the nucleic acid molecule of any one of embodiments 1-11.

13. The vector of embodiment 12, further comprising at least one nucleotide sequence encoding said gRNA capable of hybridizing to said target DNA sequence.

14. The vector of embodiment 13, where said gRNA is a single guide RNA.

15. The vector of embodiment 13, wherein said gRNA is a dual-guide RNA.

16. The vector of any one of embodiments 13-15, wherein the guide RNA comprises a CRISPR RNA comprising a CRISPR repeat sequence having at least 95% sequence identity to SEQ ID NOs: 2, 17, 25, 36, 44, 51, or 63.

17. The vector of any one of embodiments 13-16, wherein the guide RNA comprises a tracrRNA having at least 95% sequence identity to SEQ ID NOs: 3, 18, 26, 37, 45, 52, or 62.

18. A cell comprising the nucleic acid molecule of any one of embodiments 1-11 or the vector of any one of embodiments 12-17.

19. A method for making an RGN polypeptide comprising culturing the cell of embodiment 18 under conditions in which the RGN polypeptide is expressed.

20. A method for making an RGN polypeptide comprising introducing into a cell a heterologous nucleic acid molecule comprising a nucleotide sequence encoding an RNA-guided nuclease (RGN) polypeptide comprising an amino acid sequence having at least 95% sequence identity to SEQ ID NOs: 1, 16, 24, 35, 43, or 50;
wherein said RGN polypeptide binds a target DNA sequence in an RNA-guided sequence specific manner when bound to a guide RNA (gRNA) capable of hybridizing to said target DNA sequence;
and culturing said cell under conditions in which the RGN polypeptide is expressed.

21. The method of embodiment 19 or 20, further comprising purifying said RGN polypeptide.

22. The method of embodiment 19 or 20, wherein said cell further expresses one or more guide RNAs that binds to said RGN polypeptide to form an RGN ribonucleoprotein complex.

23. The method of embodiment 22, further comprising purifying said RGN ribonucleoprotein complex.

24. A nucleic acid molecule comprising a polynucleotide encoding a CRISPR RNA (crRNA), wherein said crRNA comprises a spacer sequence and a CRISPR repeat sequence, wherein said CRISPR repeat sequence comprises a nucleotide sequence having at least 95% sequence identity to SEQ ID NOs: 2, 17, 25, 36, 44, 51, or 63;
wherein a guide RNA comprising:
   a) said crRNA; and
   b) a trans-activating CRISPR RNA (tracrRNA) hybridized to said CRISPR repeat sequence of said crRNA;
is capable of hybridizing to a target DNA sequence in a sequence specific manner through the spacer sequence of said crRNA when said guide RNA is bound to an RNA-guided nuclease (RGN) polypeptide, and
wherein said polynucleotide encoding a crRNA is operably linked to a promoter heterologous to said polynucleotide.

25. A vector comprising the nucleic acid molecule of embodiment 24.

26. The vector of embodiment 25, wherein said vector further comprises a polynucleotide encoding said tracrRNA.

27. The vector of embodiment 26, wherein said tracrRNA comprises a nucleotide sequence having at least 95% sequence identity to SEQ ID NOs: 3, 18, 26, 37, 45, 52, or 62.

28. The vector of embodiment 26 or 27, wherein said polynucleotide encoding said crRNA and said polynucleotide encoding said tracrRNA are operably linked to the same promoter and are encoded as a single guide RNA.

29. The vector of embodiment 26 or 27, wherein said polynucleotide encoding said crRNA and said polynucleotide encoding said tracrRNA are operably linked to separate promoters.

30. The vector of any one of embodiments 25-29, wherein said vector further comprises a polynucleotide encoding said RGN polypeptide, wherein said RGN polypeptide comprises an amino acid sequence having at least 95% sequence identity to SEQ ID NOs: 1, 16, 24, 35, 43, or 50.

31. A nucleic acid molecule comprising a polynucleotide encoding a trans-activating CRISPR RNA (tracrRNA) comprising a nucleotide sequence having at least 95% sequence identity to SEQ ID NOs: 3, 18, 26, 37, 45, 52, or 62;
wherein a guide RNA comprising:
   a) said tracrRNA; and
   b) a crRNA comprising a spacer sequence and a CRISPR repeat sequence, wherein said tracrRNA hybridizes with said CRISPR repeat sequence of said crRNA;
is capable of hybridizing to a target DNA sequence in a sequence specific manner through the spacer sequence of said crRNA when said guide RNA is bound to an RNA-guided nuclease (RGN) polypeptide, and wherein said polynucleotide encoding a tracrRNA is operably linked to a promoter heterologous to said polynucleotide.

32. A vector comprising the nucleic acid molecule of embodiment 31.

33. The vector of embodiment 32, wherein said vector further comprises a polynucleotide encoding said crRNA.

34. The vector of embodiment 33, wherein the CRISPR repeat sequence of said crRNA comprises a nucleotide sequence having at least 95% sequence identity to SEQ ID NOs: 2, 17, 25, 36, 44, 51, or 63.

35. The vector of embodiment 33 or 34, wherein said polynucleotide encoding said crRNA and said polynucleotide encoding said tracrRNA are operably linked to the same promoter and are encoded as a single guide RNA.

36. The vector of embodiment 33 or 34, wherein said polynucleotide encoding said crRNA and said polynucleotide encoding said tracrRNA are operably linked to separate promoters.

37. The vector of any one of embodiments 32-36, wherein said vector further comprises a polynucleotide encoding said RGN polypeptide, wherein said RGN polypeptide comprises an amino acid sequence having at least 95% sequence identity to SEQ ID NOs: 1, 16, 24, 35, 43, or 50.

38. A system for binding a target DNA sequence, said system comprising:

a) one or more guide RNAs capable of hybridizing to said target DNA sequence or one or more nucleotide sequences encoding the one or more guide RNAs (gRNAs); and b) an RNA-guided nuclease (RGN) polypeptide comprising an amino acid sequence having at least 95% sequence identity to SEQ ID NOs: 1, 16, 24, 35, 43, or 50 or a nucleotide sequence encoding the RGN polypeptide;

wherein said nucleotide sequences encoding the one or more guide RNAs and encoding the RGN polypeptide are each operably linked to a promoter heterologous to said nucleotide sequence;

wherein the one or more guide RNAs hybridize to the target DNA sequence, and wherein the one or more guide RNAs form a complex with the RGN polypeptide, thereby directing said RGN polypeptide to bind to said target DNA sequence.

39. The system of embodiment 38, wherein said gRNA is a single guide RNA (sgRNA).

40. The system of embodiment 38, wherein said gRNA is a dual-guide RNA.

41. The system of any one of embodiments 38-40, wherein said gRNA comprises a CRISPR repeat sequence comprising a nucleotide sequence having at least 95% sequence identity to SEQ ID NOs: 2, 17, 25, 36, 44, 51, or 63.

42. The system of any one of embodiments 38-41, wherein said gRNA comprises a tracrRNA comprising a nucleotide sequence having at least 95% sequence identity to SEQ ID NOs: 3, 18, 26, 37, 45, 52, or 62.

43. The system of any one of embodiments 38-42, wherein said target DNA sequence is located adjacent to a protospacer adjacent motif (PAM).

44. The system of any one of embodiments 38-43, wherein the target DNA sequence is within a cell.

45. The system of embodiment 44, wherein the cell is a eukaryotic cell.

46. The system of embodiment 45, wherein the eukaryotic cell is a plant cell.

47. The system of embodiment 45, wherein the eukaryotic cell is a mammalian cell.

48. The system of embodiment 45, wherein the eukaryotic cell is an insect cell.

49. The system of embodiment 44, wherein the cell is a prokaryotic cell.

50. The system of any one of embodiments 38-49, wherein when transcribed the one or more guide RNAs hybridize to the target DNA sequence and the guide RNA forms a complex with the RGN polypeptide which causes cleavage of the target DNA sequence.

51. The system of embodiment 50, wherein the cleavage generates a double-stranded break.

52. The system of embodiment 50, wherein cleavage by said RGN polypeptide generates a single-stranded break.

53. The system of any one of embodiments 38-49, wherein said RGN polypeptide is nuclease dead or functions as a nickase.

54. The system of embodiment 53, wherein the RGN polypeptide is operably linked to a base-editing polypeptide.

55. The system of embodiment 54, wherein said base-editing polypeptide is a deaminase.

56. The system of embodiment 55, wherein said deaminase has at least 90% sequence identity to any one of SEQ ID NOs: 374, 383, 397, 399, 407, 408, 411, 414, 416, 420, 514, and 572-584.

57. The system of any one of embodiments 38-56, wherein the RGN polypeptide comprises one or more nuclear localization signals.

58. The system of any one of embodiments 38-57, wherein the RGN polypeptide is codon optimized for expression in a eukaryotic cell.

59. The system of any one of embodiments 38-58, wherein nucleotide sequences encoding the one or more guide RNAs and the nucleotide sequence encoding an RGN polypeptide are located on one vector.

60. The system of any one of embodiments 38-59, wherein said system further comprises one or more donor polynucleotides or one or more nucleotide sequences encoding the one or more donor polynucleotides.

61. A method for binding a target DNA sequence comprising delivering a system according to any one of embodiments 38-60, to said target DNA sequence or a cell comprising the target DNA sequence.

62. The method of embodiment 61, wherein said RGN polypeptide or said guide RNA further comprises a detectable label, thereby allowing for detection of said target DNA sequence.

63. The method of embodiment 61, wherein said guide RNA or said RGN polypeptide further comprises an expression modulator, thereby modulating expression of said target DNA sequence or a gene under transcriptional control by said target DNA sequence.

64. A method for cleaving or modifying a target DNA sequence comprising delivering a system according to any one of embodiments 38-60, to said target DNA sequence or a cell comprising the target DNA sequence.

65. The method of embodiment 64, wherein said modified target DNA sequence comprises insertion of heterologous DNA into the target DNA sequence.

66. The method of embodiment 64, wherein said modified target DNA sequence comprises deletion of at least one nucleotide from the target DNA sequence.

67. The method of embodiment 64, wherein said modified target DNA sequence comprises mutation of at least one nucleotide in the target DNA sequence.

68. A method for binding a target DNA sequence comprising:

a) assembling a RNA-guided nuclease (RGN) ribonucleotide complex in vitro by combining:

i) one or more guide RNAs capable of hybridizing to the target DNA sequence; and ii) an RGN polypeptide comprising an amino acid sequence having at least 95% sequence identity to SEQ ID NOs: 1, 16, 24, 35, 43, or 50;

under conditions suitable for formation of the RGN ribonucleotide complex; and b) contacting said target DNA sequence or a cell comprising said target DNA sequence with the in vitro-assembled RGN ribonucleotide complex;

wherein the one or more guide RNAs hybridize to the target DNA sequence, thereby directing said RGN polypeptide to bind to said target DNA sequence.

69. The method of embodiment 68, wherein said RGN polypeptide or said guide RNA further comprises a detectable label, thereby allowing for detection of said target DNA sequence.

70. The method of embodiment 68, wherein said guide RNA or said RGN polypeptide further comprises an expression modulator, thereby allowing for the modulation of expression of said target DNA sequence.

71. A method for cleaving and/or modifying a target DNA sequence, comprising contacting the DNA molecule with:

a) an RNA-guided nuclease (RGN) polypeptide, wherein said RGN comprises an amino acid sequence having at least 95% sequence identity to SEQ ID NOs: 1, 16, 24, 35, 43, or 50; and b) one or more guide RNAs capable of targeting the RGN of (a) to the target DNA sequence;

wherein the one or more guide RNAs hybridize to the target DNA sequence, thereby directing said RGN polypeptide to bind to said target DNA sequence and cleavage and/or modification of said target DNA sequence occurs.

72. The method of embodiment 71, wherein said modified target DNA sequence comprises insertion of heterologous DNA into the target DNA sequence.

73. The method of embodiment 71, wherein said modified target DNA sequence comprises a deletion of at least one nucleotide from the target DNA sequence.

74. The method of embodiment 71, wherein said modified target DNA sequence comprises a mutation of at least one nucleotide in the target DNA sequence.

75. The method of any one of embodiments 71-74, wherein said RGN polypeptide is a nickase.

76. The method of embodiment 73 or 74, wherein said RGN polypeptide is nuclease dead and is operably linked to a base-editing polypeptide.

77. The method of any one of embodiments 68-76, wherein said gRNA is a single guide RNA (sgRNA).

78. The method of any one of embodiments 68-76, wherein said gRNA is a dual-guide RNA.

79. The method of any one of embodiments 68-78, wherein said gRNA comprises a CRISPR repeat sequence comprising a nucleotide sequence having at least 95% sequence identity to SEQ ID NOs: 2, 17, 25, 36, 44, 51, or 63.

80. The method of any one of embodiments 68-79, wherein said gRNA comprises a tracrRNA comprising a nucleotide sequence having at least 95% sequence identity to SEQ ID NOs: 3, 18, 26, 37, 45, 52, or 62.

81. The method of any one of embodiments 68-80, wherein said target DNA sequence is located adjacent to a protospacer adjacent motif (PAM).

82. The method of any one of embodiments 61-81, wherein the target DNA sequence is within a cell.

83. The method of embodiment 82, wherein the cell is a eukaryotic cell.

84. The method of embodiment 83, wherein the eukaryotic cell is a plant cell.

85. The method of embodiment 83, wherein the eukaryotic cell is a mammalian cell.

86. The method of embodiment 83, wherein the eukaryotic cell is an insect cell.

87. The method of embodiment 82, wherein the cell is a prokaryotic cell.

88. The method of any one of embodiments 82-87, further comprising culturing the cell under conditions in which the RGN polypeptide is expressed and cleaves the target DNA sequence to produce a modified DNA sequence; and selecting a cell comprising said modified DNA sequence.

89. A cell comprising a modified target DNA sequence according to the method of embodiment 88.

90. The cell of embodiment 89, wherein the cell is a eukaryotic cell.

91. The cell of embodiment 90, wherein the eukaryotic cell is a plant cell.

92. A plant comprising the cell of embodiment 91.

93. A seed comprising the cell of embodiment 91.

94. The cell of embodiment 90, wherein the eukaryotic cell is a mammalian cell.

95. The cell of embodiment 90, wherein the eukaryotic cell is an insect cell.

96. The cell of embodiment 89, wherein the cell is a prokaryotic cell.

97. A method for producing a genetically modified cell with a correction in a causal mutation for a genetically inherited disease, the method comprising introducing into the cell:

a) an RNA-guided nuclease (RGN) polypeptide, wherein the RGN polypeptide comprises an amino acid sequence having at least 95% sequence identity to SEQ ID NOs: 1, 16, 24, 35, 43, or 50, or a polynucleotide encoding said RGN polypeptide, wherein said polynucleotide encoding the RGN polypeptide is operably linked to a promoter to enable expression of the RGN polypeptide in the cell; and b) a guide RNA (gRNA), wherein the gRNA comprises a CRISPR repeat sequence comprising a nucleotide sequence having at least 95% sequence identity to SEQ ID NOs: 2, 17, 25, 36, 44, 51, or 63, or a polynucleotide encoding said gRNA, wherein said polynucleotide encoding the gRNA is operably linked to a promoter to enable expression of the gRNA in the cell whereby the RGN and gRNA target to the genomic location of the causal mutation and modify the genomic sequence to remove the causal mutation.

98. The method of embodiment 97, wherein said RGN polypeptide is nuclease dead or functions as a nickase.

99. The method of embodiment 98, wherein the RGN polypeptide is operably linked to a base-editing polypeptide.

100. The method of embodiment 99, wherein said base-editing polypeptide is a deaminase.

101. The method of embodiment 100, wherein the deaminase comprises an amino acid sequence having at least 90% sequence identity to any one of SEQ ID NOs: 374, 383, 397, 399, 407, 408, 411, 414, 416, 420, 514, and 572-584.

102. The method of any one of embodiments 97-101, wherein the cell is an animal cell.

103. The method of embodiment 102, wherein the animal cell is a mammalian cell.

104. The method of embodiment 103, wherein the cell is derived from a dog, cat, mouse, rat, rabbit, horse, cow, pig, or human.

105. The method of embodiment 102, wherein the genetically inherited disease is a disease listed in Table 8.

106. The method of embodiment 102, wherein the genetically inherited disease is Hurler Syndrome.

107. The method of embodiment 106, wherein the gRNA comprises a spacer sequence that targets SEQ ID NO: 337.

108. A method for producing a genetically modified cell with a deletion in a disease-causing genomic region of instability, the method comprising introducing into the cell:

a) an RNA-guided nuclease (RGN) polypeptide, wherein the RGN polypeptide comprises an amino acid sequence having at least 95% sequence identity to SEQ ID NOs: 1, 16, 24, 35, 43, or 50, or a polynucleotide encoding said RGN polypeptide, wherein said polynucleotide encoding the RGN polypeptide is operably linked to a promoter to enable expression of the RGN polypeptide in the cell; and b) a first guide RNA (gRNA), wherein the gRNA comprises a CRISPR repeat sequence comprising a nucleotide sequence having at least 95% sequence identity to SEQ ID NOs: 2, 17, 25, 36, 44, 51, or 63, or a polynucleotide encoding said gRNA, wherein said polynucleotide encoding the gRNA is operably linked to a promoter to enable expression of the gRNA in the cell, and further wherein the gRNA comprises a spacer sequence that targets the 5'flank of the genomic region of instability; and c) a second guide RNA (gRNA), wherein the gRNA comprises a CRISPR repeat sequence comprising a nucleotide sequence having at least 95% sequence identity to SEQ ID NOs: 2, 17, 25, 36, 44, 51, or 63, or a polynucleotide encoding said gRNA, wherein said polynucleotide encoding the gRNA is operably linked to a promoter to enable expression of the gRNA in the cell, and further wherein said second gRNA comprises a spacer sequence that targets the 3'flank of the genomic region of instability;

whereby the RGN and the two gRNAs target to the genomic region of instability and at least a portion of the genomic region of instability is removed.

109. The method of embodiment 108, wherein the cell is an animal cell.

110. The method of embodiment 108, wherein the cell is a mammalian cell.

111. The method of embodiment 110, wherein the cell is derived from a dog, cat, mouse, rat, rabbit, horse, cow, pig, or human.

112. The method of embodiment 109, wherein the genetically inherited disease is Friedrich's Ataxia or Huntington's Disease.

113. The method of embodiment 112, wherein the first gRNA comprises a spacer sequence that targets SEQ ID NO: 340, 341, 342, or 343.

114. The method of embodiment 113, wherein the second gRNA comprises a spacer sequence that targets SEQ ID NO: 340, 341, 342, or 343.

115. A method for producing a genetically modified mammalian hematopoietic progenitor cell having decreased BCL11A mRNA and protein expression, the method comprising introducing into an isolated human hematopoietic progenitor cell:

a) an RNA-guided nuclease (RGN) polypeptide, wherein the RGN polypeptide comprises an amino acid sequence having at least 95% sequence identity to SEQ ID NOs: 1, 16, 24, 35, 43, or 50, or a polynucleotide encoding said RGN polypeptide, wherein said polynucleotide encoding the RGN polypeptide is operably linked to a promoter to enable expression of the RGN polypeptide in the cell; and b) a guide RNA (gRNA), wherein the gRNA comprises a CRISPR repeat sequence comprising a nucleotide sequence having at least 95% sequence identity to SEQ ID NOs: 2, 17, 25, 36, 44, 51, or 63, or a polynucleotide encoding said gRNA, wherein said polynucleotide encoding the gRNA is operably linked to a promoter to enable expression of the gRNA in the cell, whereby the RGN and gRNA are expressed in the cell and cleave at the BCL11A enhancer region, resulting in genetic modification of the human hematopoietic progenitor cell and reducing the mRNA and/or protein expression of BCL11A.

116. The method of embodiment 115, wherein the gRNA further comprises a spacer sequence that targets SEQ ID NO: 350, 351, or 352.

117. A system for binding a target DNA sequence, said system comprising:

a) one or more guide RNAs capable of hybridizing to said target DNA sequence or one or more nucleotide sequences encoding the one or more guide RNAs (gRNAs); and b) an RNA-guided nuclease (RGN) polypeptide comprising an amino acid sequence having at least 95% sequence identity to SEQ ID NOs: 1, 16, 24, 35, 43, or 50;

wherein the one or more guide RNAs hybridize to the target DNA sequence, and wherein the one or more guide RNAs forms a complex with the RGN polypeptide, thereby directing said RGN polypeptide to bind to said target DNA sequence.

118. The system of embodiment 117, wherein said RGN polypeptide is nuclease dead or functions as a nickase.

119. The system of embodiment 117 or 118, wherein said RGN polypeptide is operably fused to a base-editing polypeptide.

120. The system of embodiment 119, wherein the base-editing polypeptide is a deaminase.

121. The system of embodiment 120, wherein the deaminase polypeptide comprises an amino acid sequence having at least 95% sequence identity to any one of SEQ ID NOs: 374, 383, 397, 399, 407, 408, 411, 414, 416, 420, 514, and 572-584.

122. A nucleic acid molecule comprising a polynucleotide encoding a deaminase polypeptide, wherein said polynucleotide comprises a nucleotide sequence encoding a deaminase polypeptide comprising an amino acid sequence having at least 90% sequence identity to SEQ ID NOs: 374, 383, 397, 399, 407, 408, 411, 414, 416, or 420;

wherein said deaminase polypeptide deaminates at least one nucleotide in a target polynucleotide; and wherein said polynucleotide encoding a deaminase polypeptide is operably linked to a promoter heterologous to said polynucleotide.

123. The nucleic acid molecule of embodiment 122, wherein the deaminase polypeptide is codon optimized for expression in a eukaryotic cell.

124. The nucleic acid molecule of embodiment 122 or 123, wherein the deaminase polypeptide is operably linked to a DNA-binding polypeptide that localizes said deaminase polypeptide to said target polynucleotide.

125. The nucleic acid molecule of embodiment 124, wherein the DNA-binding polypeptide is a meganuclease, zinc finger fusion protein, or a TALEN.

126. The nucleic acid molecule of embodiment 124, wherein the DNA-binding polypeptide acts in complex with an RNA guide and is therefore RNA-guided.

127. The nucleic acid molecule of embodiment 126, wherein the RNA-guided, DNA-binding polypeptide is or is derived from an RNA-guided nuclease polypeptide.

128. The nucleic acid molecule of embodiment 127, wherein the RNA-guided nuclease polypeptide is a Type II CRISPR-Cas polypeptide.

129. The nucleic acid molecule of embodiment 127, wherein the RNA-guided nuclease polypeptide is a Type V CRISPR-Cas polypeptide.

130. The nucleic acid molecule of any one of embodiments 126-129, wherein the RNA-guided, DNA-binding polypeptide is a nickase.

131. The nucleic acid molecule of embodiment 127, wherein the RNA-guided nuclease polypeptide has at least 95% sequence identity to SEQ ID NOs: 1, 16, 24, 35, 43, or 50.

132. The nucleic acid molecule of any one of embodiments 124-131, wherein the deaminase polypeptide is operably linked to a uracil glycosylase inhibitor (UGI) polypeptide.

133. The nucleic acid molecule of embodiment 132, wherein the UGI polypeptide is at least 85% identical to the amino acid sequence of SEQ ID NO: 570.

134. The nucleic acid molecule of any one of embodiments 122-133, wherein the deaminase polypeptide further comprises a nuclear localization signal (NLS).

135. A vector comprising the nucleic acid molecule of any one of embodiments 122-134.

136. A vector comprising the nucleic acid molecule of any one of embodiments 126-134, wherein said vector further comprises at least one nucleotide sequence encoding a guide RNA (gRNA) capable of hybridizing to said target polynucleotide and acting in complex with said RNA-guided, DNA-binding polypeptide.

137. The vector of embodiment 136, where said gRNA is a single guide RNA.

138. The vector of embodiment 136, wherein said gRNA is a dual-guide RNA.

139. A cell comprising the nucleic acid molecule of any one of embodiments 122-134 or the vector of any one of embodiments 135-138.

140. A method for making a deaminase polypeptide comprising culturing the cell of embodiment 139 under conditions in which the deaminase polypeptide is expressed.

141. A nucleic acid molecule comprising a polynucleotide encoding an adenosine deaminase polypeptide, wherein said polynucleotide comprises a nucleotide sequence encoding an adenosine deaminase polypeptide comprising an amino acid sequence selected from the group consisting of:

a) an amino acid sequence having at least 90% sequence identity to SEQ ID NO: 514;

b) an amino acid sequence having at least 90% sequence identity to SEQ ID NO: 572, and comprising a lysine at a position corresponding to position 102 of SEQ ID NO: 572, a tyrosine at a position corresponding to position 104 of SEQ ID NO: 572, and a threonine at a position corresponding to position 106 of SEQ ID NO: 572;

c) an amino acid sequence having at least 90% sequence identity to SEQ ID NO: 573;

d) an amino acid sequence having at least 90% sequence identity to SEQ ID NO: 574, and comprising a glutamic acid at a position corresponding to position 101 of SEQ ID NO: 574, a serine at a position corresponding to position 103 of SEQ ID NO: 574, and a lysine at a position corresponding to position 105 of SEQ ID NO: 574;

e) an amino acid sequence having at least 90% sequence identity to SEQ ID NO: 575, and comprising a lysine at a position corresponding to position 101 of SEQ ID NO: 575, a leucine at a position corresponding to position 103 of SEQ ID NO: 575, and a glutamic acid at a position corresponding to position 105 of SEQ ID NO: 575;

f) an amino acid sequence having at least 90% sequence identity to SEQ ID NO: 576, and comprising an alanine at a position corresponding to position 105 of SEQ ID NO: 576 and an arginine at a position corresponding to position 107 of SEQ ID NO: 576;

g) an amino acid sequence having at least 90% sequence identity to SEQ ID NO: 577, and comprising a glycine at a position corresponding to position 102 of SEQ ID NO: 577, a serine at a position corresponding to position 104 of SEQ ID NO: 577, and an arginine at a position corresponding to position 106 of SEQ ID NO: 577;

h) an amino acid sequence having at least 90% sequence identity to SEQ ID NO: 578, and comprising a serine at a position corresponding to position 105 of SEQ ID NO: 578 and a threonine at a position corresponding to position 107 of SEQ ID NO: 578;

i) an amino acid sequence having at least 90% sequence identity to SEQ ID NO: 579, and comprising a serine at a position corresponding to position 102 of SEQ ID NO: 579, a glutamine at a position corresponding to position 104 of SEQ ID NO: 579, and a glycine at a position corresponding to position 106 of SEQ ID NO: 579;

j) an amino acid sequence having at least 90% sequence identity to SEQ ID NO: 580, and comprising a glycine at a position corresponding to position 111 of SEQ ID NO: 580;

k) an amino acid sequence having at least 90% sequence identity to SEQ ID NO: 581, and comprising a glutamine at a position corresponding to position 104 of SEQ ID NO: 581, a glycine at a position corresponding to position 106 of SEQ ID NO: 581, and a glutamic acid at a position corresponding to position 108 of SEQ ID NO: 581;

l) an amino acid sequence having at least 90% sequence identity to SEQ ID NO: 582, and comprising an arginine at a position corresponding to position 102 of SEQ ID NO: 582, a tryptophan at a position corresponding to position 104 of SEQ ID NO: 582, and a glutamic acid at a position corresponding to position 106 of SEQ ID NO: 582;

m) an amino acid sequence having at least 90% sequence identity to SEQ ID NO: 583, and comprising an arginine at a position corresponding to position 104 of SEQ ID NO: 583 and a serine at a position corresponding to position 106 of SEQ ID NO: 583; and n) an amino acid sequence having at least 90% sequence identity to SEQ ID NO: 584, and comprising a phenylalanine at a position corresponding to position 110 of SEQ ID NO: 584, a serine at a position corresponding to position 112 of SEQ ID NO: 584, and a threonine at a position corresponding to position 114 of SEQ ID NO: 584;

wherein said adenosine deaminase polypeptide deaminates at least one adenosine in a target polynucleotide; and wherein said polynucleotide encoding an adenosine deaminase polypeptide is operably linked to a promoter heterologous to said polynucleotide.

142. The nucleic acid molecule of embodiment 141, wherein said adenosine deaminase polypeptide is codon optimized for expression in a eukaryotic cell.

143. The nucleic acid molecule of embodiment 141 or 142, wherein the adenosine deaminase polypeptide is operably linked to a DNA-binding polypeptide that localizes said adenosine deaminase polypeptide to said target polynucleotide.

144. The nucleic acid molecule of embodiment 143, wherein the DNA-binding polypeptide is a meganuclease, zinc finger fusion protein, or a TALEN.

145. The nucleic acid molecule of embodiment 143, wherein the DNA-binding polypeptide acts in complex with an RNA guide and is therefore RNA-guided.

146. The nucleic acid molecule of embodiment 145, wherein the RNA-guided, DNA-binding polypeptide is or is derived from an RNA-guided nuclease polypeptide.

147. The nucleic acid molecule of embodiment 146, wherein the RNA-guided nuclease polypeptide is a Type II CRISPR-Cas polypeptide.

148. The nucleic acid molecule of embodiment 146, wherein the RNA-guided nuclease polypeptide is a Type V CRISPR-Cas polypeptide.

149. The nucleic acid molecule of any one of embodiments 145-148, wherein the RNA-guided, DNA-binding polypeptide is a nickase.

150. The nucleic acid molecule of embodiment 146, wherein the RNA-guided nuclease polypeptide has at least 95% sequence identity to SEQ ID NOs: 1, 16, 24, 35, 43, or 50.

151. The nucleic acid molecule of any one of embodiments 141-150, wherein the adenosine deaminase polypeptide is operably linked to a uracil glycosylase inhibitor (UGI) polypeptide.

152. The nucleic acid molecule of embodiment 151, wherein the UGI polypeptide is at least 85% identical to the amino acid sequence of SEQ ID NO: 570.

153. The nucleic acid molecule of any one of embodiments 141-152, wherein the adenosine deaminase polypeptide further comprises a nuclear localization signal (NLS).

154. A vector comprising the nucleic acid molecule of any one of embodiments 141-153.

155. A vector comprising the nucleic acid molecule of any one of embodiments 145-153, wherein said vector further comprises at least one nucleotide sequence encoding a guide RNA (gRNA) capable of hybridizing to said target polynucleotide and acting in complex with said RNA-guided, DNA-binding polypeptide.

156. The vector of embodiment 155, where said gRNA is a single guide RNA.

157. The vector of embodiment 155, wherein said gRNA is a dual-guide RNA.

158. A cell comprising the nucleic acid molecule of any one of embodiments 141-153 or the vector of any one of embodiments 154-157.

159. A method for making an adenosine deaminase polypeptide comprising culturing the cell of embodiment 158 under conditions in which the adenosine deaminase polypeptide is expressed.

160. A fusion protein comprising:

a) a DNA-binding polypeptide that binds to a target polynucleotide; and b) a deaminase polypeptide, wherein said deaminase polypeptide comprises an amino acid sequence having at least 90% sequence identity to SEQ ID NOs: 374, 383, 397, 399, 407, 408, 411, 414, 416, or 420, and wherein said deaminase polypeptide deaminates at least one nucleotide in said target polynucleotide.

161. The fusion protein of embodiment 160, wherein the DNA-binding polypeptide is a meganuclease, zinc finger fusion protein, or a TALEN.

162. The fusion protein of embodiment 160, wherein the DNA-binding polypeptide acts in complex with an RNA guide and is therefore RNA-guided.

163. The fusion protein of embodiment 162, wherein the RNA-guided, DNA-binding polypeptide is or is derived from an RNA-guided nuclease polypeptide.

164. The fusion protein of embodiment 163, wherein the RNA-guided nuclease polypeptide is a Type II CRISPR-Cas polypeptide.

165. The fusion protein of embodiment 163, wherein the RNA-guided nuclease polypeptide is a Type V CRISPR-Cas polypeptide.

166. The fusion protein of any one of embodiments 162-165, wherein the RNA-guided, DNA-binding polypeptide is a nickase.

167. The fusion protein of embodiment 163, wherein the RNA-guided nuclease polypeptide has at least 95% sequence identity to SEQ ID NOs: 1, 16, 24, 35, 43, or 50.

168. The fusion protein of any one of embodiments 160-167, wherein the fusion protein further comprises a uracil glycosylase inhibitor (UGI) polypeptide.

169. The fusion protein of embodiment 168, wherein the UGI polypeptide is at least 85% identical to the amino acid sequence of SEQ ID NO: 570.

170. The fusion protein of any one of embodiments 160-169, wherein the fusion protein further comprises a nuclear localization signal (NLS).

171. A fusion protein comprising:

a) a DNA-binding polypeptide that binds to a target polynucleotide; and b) an adenosine deaminase polypeptide comprising an amino acid sequence selected from the group consisting of:

i) an amino acid sequence having at least 90% sequence identity to SEQ ID NO: 514;

ii) an amino acid sequence having at least 90% sequence identity to SEQ ID NO: 572, and comprising a lysine at a position corresponding to position 102 of SEQ ID NO: 572, a tyrosine at a position corresponding to position 104 of SEQ ID NO: 572, and a threonine at a position corresponding to position 106 of SEQ ID NO: 572;

iii) an amino acid sequence having at least 90% sequence identity to SEQ ID NO: 573;

iv) an amino acid sequence having at least 90% sequence identity to SEQ ID NO: 574, and comprising a glutamic acid at a position corresponding to position 101 of SEQ ID NO: 574, a serine at a position corresponding to position 103 of SEQ ID NO: 574, and a lysine at a position corresponding to position 105 of SEQ ID NO: 574;

v) an amino acid sequence having at least 90% sequence identity to SEQ ID NO: 575, and comprising a lysine at a position corresponding to position 101 of SEQ ID NO: 575, a leucine at a position corresponding to position 103 of SEQ ID NO: 575, and a glutamic acid at a position corresponding to position 105 of SEQ ID NO: 575;

vi) an amino acid sequence having at least 90% sequence identity to SEQ ID NO: 576, and comprising an alanine at a position corresponding to position 105 of SEQ ID NO: 576 and an argnine at a position corresponding to position 107 of SEQ ID NO: 576;

vii) an amino acid sequence having at least 90% sequence identity to SEQ ID NO: 577, and comprising a glycine at a position corresponding to position 102 of SEQ ID NO: 577, a serine at a position corresponding to position 104 of SEQ ID NO: 577, and an arginine at a position corresponding to position 106 of SEQ ID NO: 577;

viii) an amino acid sequence having at least 90% sequence identity to SEQ ID NO: 578, and comprising a serine at a position corresponding to position 105 of SEQ ID NO: 578 and a threonine at a position corresponding to position 107 of SEQ ID NO: 578;

ix) an amino acid sequence having at least 90% sequence identity to SEQ ID NO: 579, and comprising a serine at a position corresponding to position 102 of SEQ ID NO: 579, a glutamine at a position corresponding to position 104 of SEQ ID NO: 579, and a glycine at a position corresponding to position 106 of SEQ ID NO: 579;

x) an amino acid sequence having at least 90% sequence identity to SEQ ID NO: 580, and comprising a glycine at a position corresponding to position 111 of SEQ ID NO: 580;

xi) an amino acid sequence having at least 90% sequence identity to SEQ ID NO: 581, and comprising a glutamine at a position corresponding to position 104 of SEQ ID NO: 581, a glycine at a position corresponding to position 106 of SEQ ID NO: 581, and a glutamic acid at a position corresponding to position 108 of SEQ ID NO: 581;

xii) an amino acid sequence having at least 90% sequence identity to SEQ ID NO: 582, and comprising an arginine at a position corresponding to position 102 of SEQ ID NO: 582, a tryptophan at a position corresponding to position 104 of SEQ ID NO: 582, and a glutamic acid at a position corresponding to position 106 of SEQ ID NO: 582;

xiii) an amino acid sequence having at least 90% sequence identity to SEQ ID NO: 583, and comprising an arginine at a position corresponding to position 104 of SEQ ID NO: 583 and a serine at a position corresponding to position 106 of SEQ ID NO: 583; and xiv) an amino acid sequence having at least 90% sequence identity to SEQ ID NO: 584, and comprising a phenylalanine at a position corresponding to position 110 of SEQ ID NO: 584, a serine at a position corresponding to position 112 of SEQ ID NO: 584, and a threonine at a position corresponding to position 114 of SEQ ID NO: 584;

wherein said adenosine deaminase polypeptide deaminates at least one adenosine in a target polynucleotide.

172. The fusion protein of embodiment 171, wherein the DNA-binding polypeptide is a meganuclease, zinc finger fusion protein, or a TALEN.

173. The fusion protein of embodiment 171, wherein the DNA-binding polypeptide acts in complex with an RNA guide and is therefore RNA-guided.

174. The fusion protein of embodiment 173, wherein the RNA-guided, DNA-binding polypeptide is or is derived from an RNA-guided nuclease polypeptide.

175. The fusion protein of embodiment 174, wherein the RNA-guided nuclease polypeptide is a Type II CRISPR-Cas polypeptide.

176. The fusion protein of embodiment 174, wherein the RNA-guided nuclease polypeptide is a Type V CRISPR-Cas polypeptide.

177. The fusion protein of any one of embodiments 173-176, wherein the RNA-guided, DNA-binding polypeptide is a nickase.

178. The fusion protein of embodiment 174, wherein the RNA-guided nuclease polypeptide has at least 95% sequence identity to SEQ ID NOs: 1, 16, 24, 35, 43, or 50.

179. The fusion protein of any one of embodiments 171-178, wherein the fusion protein further comprises a uracil glycosylase inhibitor (UGI) polypeptide.

180. The fusion protein of embodiment 179, wherein the UGI polypeptide is at least 85% identical to the amino acid sequence of SEQ ID NO: 570.

181. The fusion protein of any one of embodiments 171-180, wherein the fusion protein further comprises a nuclear localization signal (NLS).

182. A system for modifying a target polynucleotide sequence, said system comprising:

a) one or more guide RNAs capable of hybridizing to said target polynucleotide sequence or one or more nucleotide sequences encoding the one or more guide RNAs (gRNAs); and b) a fusion protein of any one of embodiments 162-170 and 173-181 or a nucleotide sequence encoding said fusion protein;

wherein said nucleotide sequences encoding the one or more guide RNAs and encoding the fusion protein are each operably linked to a promoter heterologous to said nucleotide sequence;

wherein the one or more guide RNAs hybridize to the target polynucleotide sequence, and wherein the one or more guide RNAs form a complex with the RNA-guided DNA-binding polypeptide of the fusion protein, thereby directing said fusion protein to bind to and modify said target polynucleotide sequence.

183. The system of embodiment 182, wherein said gRNA is a single guide RNA (sgRNA).

184. The system of embodiment 182, wherein said gRNA is a dual-guide RNA.

185. The system of any one of embodiments 182-184, wherein said target polynucleotide sequence is located adjacent to a protospacer adjacent motif (PAM).

186. The system of any one of embodiments 182-185, wherein the target polynucleotide sequence is within a cell.

187. The system of embodiment 186, wherein the cell is a eukaryotic cell.

188. The system of embodiment 187, wherein the eukaryotic cell is a plant cell.

189. The system of embodiment 187, wherein the eukaryotic cell is a mammalian cell.

190. The system of embodiment 187, wherein the eukaryotic cell is an insect cell.

191. The system of embodiment 186, wherein the cell is a prokaryotic cell.

192. A method for deaminating a target polynucleotide, said method comprising contacting said target polynucleotide with a deaminase comprising an amino acid sequence having at least 90% sequence identity to SEQ ID NOs: 374, 383, 397, 399, 407, 408, 411, 414, 416, or 420, wherein said deaminase polypeptide deaminates at least one nucleotide in said target polynucleotide.

193. A method for deaminating at least one adenosine in a target polynucleotide, said method comprising contacting said target polynucleotide with an adenosine deaminase polypeptide comprising an amino acid sequence selected from the group consisting of:

a) an amino acid sequence having at least 90% sequence identity to SEQ ID NO: 514;

b) an amino acid sequence having at least 90% sequence identity to SEQ ID NO: 572, and comprising a lysine at a position corresponding to position 102 of SEQ ID NO: 572, a tyrosine at a position corresponding to position 104 of SEQ ID NO: 572, and a threonine at a position corresponding to position 106 of SEQ ID NO: 572;

c) an amino acid sequence having at least 90% sequence identity to SEQ ID NO: 573;

d) an amino acid sequence having at least 90% sequence identity to SEQ ID NO: 574, and comprising a glutamic acid at a position corresponding to position 101 of SEQ ID NO: 574, a serine at a position corresponding to position 103 of SEQ ID NO: 574, and a lysine at a position corresponding to position 105 of SEQ ID NO: 574;

e) an amino acid sequence having at least 90% sequence identity to SEQ ID NO: 575, and comprising a lysine at a position corresponding to position 101 of SEQ ID NO: 575, a leucine at a position corresponding to position 103 of SEQ ID NO: 575, and a glutamic acid at a position corresponding to position 105 of SEQ ID NO: 575;

f) an amino acid sequence having at least 90% sequence identity to SEQ ID NO: 576, and comprising an alanine at a position corresponding to position 105 of SEQ ID NO: 576 and an argnine at a position corresponding to position 107 of SEQ ID NO: 576;

g) an amino acid sequence having at least 90% sequence identity to SEQ ID NO: 577, and comprising a glycine at a position corresponding to position 102 of SEQ ID NO: 577, a serine at a position corresponding to position 104 of SEQ ID NO: 577, and an arginine at a position corresponding to position 106 of SEQ ID NO: 577;

h) an amino acid sequence having at least 90% sequence identity to SEQ ID NO: 578, and comprising a serine at a position corresponding to position 105 of SEQ ID NO: 578 and a threonine at a position corresponding to position 107 of SEQ ID NO: 578;

i) an amino acid sequence having at least 90% sequence identity to SEQ ID NO: 579, and comprising a serine at a position corresponding to position 102 of SEQ ID NO: 579, a glutamine at a position corresponding to position 104 of SEQ ID NO: 579, and a glycine at a position corresponding to position 106 of SEQ ID NO: 579;

j) an amino acid sequence having at least 90% sequence identity to SEQ ID NO: 580, and comprising a glycine at a position corresponding to position 111 of SEQ ID NO: 580;

k) an amino acid sequence having at least 90% sequence identity to SEQ ID NO: 581, and comprising a glutamine at a position corresponding to position 104 of SEQ ID NO: 581, a glycine at a position corresponding to position 106 of SEQ ID NO: 581, and a glutamic acid at a position corresponding to position 108 of SEQ ID NO: 581;

l) an amino acid sequence having at least 90% sequence identity to SEQ ID NO: 582, and comprising an arginine at a position corresponding to position 102 of SEQ ID NO: 582, a tryptophan at a position corresponding to position 104 of SEQ ID NO: 582, and a glutamic acid at a position corresponding to position 106 of SEQ ID NO: 582;

m) an amino acid sequence having at least 90% sequence identity to SEQ ID NO: 583, and comprising an arginine at a position corresponding to position 104 of SEQ ID NO: 583 and a serine at a position corresponding to position 106 of SEQ ID NO: 583; and n) an amino acid sequence having at least 90% sequence identity to SEQ ID NO: 584, and comprising a phenylalanine at a position corresponding to position 110 of SEQ ID NO: 584, a serine at a position corresponding to position 112 of SEQ ID NO: 584, and a threonine at a position corresponding to position 114 of SEQ ID NO: 584;

wherein said adenosine deaminase polypeptide deaminates at least one adenosine in a target polynucleotide.

194. A method for modifying a target polynucleotide, said method comprising contacting said target polynucleotide with a fusion protein of any one of embodiments 160, 161, 171, and 172, wherein said DNA-binding polypeptide binds to said target polynucleotide and said deaminase deaminates at least one nucleotide in said target polynucleotide.

195. A method for modifying a target polynucleotide, said method comprising contacting said target polynucleotide with a fusion protein of any one of embodiments 162-170 and 173-181, and introducing one or more guide RNAs (gRNAs) or one or more nucleotide sequences encoding the one or more gRNAs;

wherein the one or more gRNAs hybridize to said target polynucleotide and form a complex with the RNA-guided DNA-binding polypeptide of the fusion protein, thereby directing said fusion protein to bind to said target polynucleotide sequence and said deaminase polypeptide of the fusion protein deaminates at least one nucleotide in said target polynucleotide, thereby modifying said target polynucleotide.

196. The method of embodiment 195, wherein the target polynucleotide is within a cell.

197. The method of embodiment 196, wherein the cell is a eukaryotic cell.

198. The method of embodiment 197, wherein the eukaryotic cell is a mammalian cell.

199. The method of embodiment 197, wherein the eukaryotic cell is a plant cell.

74

RGNs. Table 1 provides the name of each RGN, its amino acid sequence, the source from which it was derived, and processed crRNA repeat sequences, and tracrRNA sequences. Table 1 further provides a generic single guide RNA (sgRNA) sequence which determines the nucleic acid target sequence of the sgRNA. The location of the spacer sequence is indicated by a poly-N sequence. This poly-N sequence is only to indicate the location of the spacer sequence in the sgRNA, and does not indicate length required for a functional spacer sequence. Type II-C RGN systems each have a conserved sequence in the base of the hairpin stem of the tracrRNA: APG00969 has UNANNC (SEQ ID NO: 13); APG03128 has ANGNNU (SEQ ID NO: 23); and APG00771 has UNANNA (SEQ ID NO: 42).

TABLE 1

Summary of SEQ IDs and CRISPR associated systems

| RGN ID | SEQ ID NO. | Source | crRNA repeat seq (SEQ ID NO.) | tracrRNA (SEQ ID NO.) | sgRNA (SEQ ID NO) |
|---|---|---|---|---|---|
| APG00969 | 1 | Bacillus sp. | 2 | 3 | 4 |
| APG03128 | 16 | Rhizobium sp. | 17 | 18 | 19 |
| APG09748 | 24 | Brevibacillus sp. | 25 | 26 | 27 |
| APG00771 | 35 | Chryseobacterium sp. | 36 | 37 | 38 |
| APG02789 | 43 | Bacillus sp. | 44 | 45 | 46 |
| APG09106 | 50 | Brevibacillus sp. | 51 | 52 | 53 |

200. The method of any one of embodiments 195 to 199, wherein the modification of the target polynucleotide comprises a C to T point mutation.

201. The method of embodiment 200, wherein the deamination of the C base results in correcting a sequence that is associated with a disease or disorder.

202. The method of embodiment 200, wherein the modification of the target polynucleotide comprises a C to T change in the genome of a crop plant, and wherein deamination of the C base results in a sequence which improves the agronomic qualities of the crop plant.

203. The method of any one of embodiments 195 to 199, wherein the modification of the target polynucleotide comprises an A to G point mutation.

204. The method of embodiment 203, wherein the deamination of the A base results in correcting a sequence that is associated with a disease or disorder.

205. The method of embodiment 203, wherein the modification of the target polynucleotide comprises an A to G change in the genome of a crop plant, and wherein deamination of the A base results in a sequence which improves the agronomic qualities of the crop plant.

The following examples are offered by way of illustration and not by way of limitation.

EXPERIMENTAL

Example 1. Identification of RNA-Guided Nucleases

Six distinct CRISPR-associated RNA-guided nucleases (RGN's) were identified and are described in Table 1 below. APG00969, APG03128, and APG00771 are Type II-C RGNs. APG09748, APG02789 and APG09106 are Type V-B Example 2: Guide RNA Identification and sgRNA Construction Cultures of bacteria that natively express the RNA-guided nuclease system under investigation were grown to mid-log phase (OD600 of ~0.600), pelleted, and flash frozen. RNA was isolated from the pellets using a mirVANA miRNA Isolation Kit (Life Technologies, Carlsbad, CA), and sequencing libraries were prepared from the isolated RNA using an NEBNext Small RNA Library Prep kit (NEB, Beverly, MA). The library prep was fractionated on a 6% polyacrylamide gel into 2 size fractions corresponding to 18-65 nt and 90-200 nt RNA species to detect crRNAs and tracrRNAs, respectively. Deep sequencing (40 bp paired-end for the smaller fraction and 80 bp paired-end for the larger fraction) was performed on a Next Seq 500 (High Output kit) by a service provider (MoGene, St. Louis, MO). Reads were quality trimmed using Cutadapt and mapped to reference genomes using Bowtie2. A custom RNAseq pipeline was written in Python to detect the crRNA and tracrRNA transcripts. Processed crRNA boundaries were determined by sequence coverage of the native repeat spacer array. The anti-repeat portion of the tracrRNA was identified using permissive BLASTn parameters. RNA sequencing depth confirmed the boundaries of the processed tracrRNA by identifying the transcript containing the anti-repeat. Manual curation of RNAs was performed using secondary structure prediction by NUPACK, an RNA folding software. Alternatively, the tracrRNA for APG02789 was determined bioinformatically by the anti-repeat sequence and not through small RNA sequencing. Generally, sgRNA cassettes were prepared by DNA synthesis and were generally designed as follows for APG00771, APG03128, and APG00969: (5'→3') 20-30 bp spacer sequence—processed repeat portion of the crRNA—4 bp noncomplementary linker (AAAG; SEQ ID NO: 8)—processed tracrRNA. For APG09748, APG09106, and APG02789, the sgRNA cassettes were designed as the following (5'→3'): processed tracrRNA—4 bp noncomplementary linker (AAAG; SEQ ID NO: 8)—processed repeat portion of the crRNA)—20-30 bp target spacer sequence. Other 4 bp or 6 bp noncomplementary linkers known in the art may also be used for sgRNA design. For in vitro assays, sgRNAs were synthesized by in vitro transcription of the sgRNA cassettes with a GeneArt™ Precision gRNA Synthesis Kit (ThermoFisher). Processed crRNA and tracrRNA sequences for each of the RGN polypeptides are identified and are set forth in Table 1. See below for the sgRNAs constructed for PAM libraries 1 and 2.

Example 3: Determination of PAM Requirements for Each RGN

PAM requirements for each RGN were determined using a PAM depletion assay essentially adapted from Kleinstiver et al. (2015) *Nature* 523:481-485 and Zetsche et al. (2015) *Cell* 163:759-771. Briefly, two plasmid libraries (L1 and L2) were generated in a pUC18 backbone (ampR), with each containing a distinct 30 bp protospacer (target) sequence flanked by 8 random nucleotides (i.e., the PAM region). The target sequence and flanking PAM region of library 1 and library 2 for RGNs APG00969, APG03128, and APG00771 are SEQ ID NOs: 14 and 15, respectively. The target sequence and flanking PAM region of library 1 and library 2 for RGNs AP09748, APG02789, and APG09106 are SEQ ID NOs: 32 and 33, respectively.

The libraries were separately electroporated into *E. coli* BL21(DE3) cells harboring pRSF-1b expression vectors containing an RGN of the invention (codon optimized for *E. coli*) along with a cognate sgRNA containing a spacer sequence corresponding to the protospacer in L1 or L2. Sufficient library plasmid was used in the transformation reaction to obtain >10^6 CFU. Both the RGN and sgRNA in the pRSF-1b backbone were under the control of T7 promoters. The transformation reaction was allowed to recover for 1 hr after which it was diluted into LB media containing carbenicillin and kanamycin and grown overnight. The following day the mixture was diluted into self-inducing Overnight Express™ Instant TB Medium (Millipore Sigma) to allow expression of the RGN and sgRNA, and grown for an additional 4 h or 20 h after which the cells were spun down and plasmid DNA was isolated with a Mini-prep kit (Qiagen, Germantown, MD). In the presence of the appropriate sgRNA, plasmids containing a PAM that is recognizable by the RGN will be cleaved resulting in their removal from the population. Plasmids containing PAMs that are not recognizable by the RGN, or that are transformed into bacteria not containing an appropriate sgRNA, will survive and replicate. The PAM and protospacer regions of uncleaved plasmids were PCR-amplified and prepared for sequencing following published protocols (16s-metagenomic library prep guide 15044223B, Illumina, San Diego, CA). Deep sequencing (80 bp single end reads) was performed on a MiSeq (Illumina) by a service provider (MoGene, St. Louis, MO). Typically, 1-4M reads were obtained per amplicon. PAM regions were extracted, counted, and normalized to total reads for each sample. PAMs that lead to plasmid cleavage were identified by being underrepresented when compared to controls (i.e., when the library is transformed into *E. coli* containing the RGN but lacking an appropriate sgRNA). To represent PAM requirements for a novel RGN, the depletion ratios (frequency in sample/ frequency in control) for all sequences in the region in question were converted to enrichment values with a –log base 2 transformation. Sufficient PAMs were defined as those with enrichment values>2.3 (which corresponds to depletion ratios<~0.2). PAMs above this threshold in both libraries were collected and used to generate web logos, which for example can be generated using a web-based service on the internet known as "weblogo". PAM sequences were identified and reported when there was a consistent pattern in the top enriched PAMs. A PAM (having an enrichment factor (EF)>2.3) for each RGN is provided in Table 2. For some RGNs, non-limiting exemplary PAMs (having an EF>3.3) were also identified. The PAM orientation is 5'-target-PAM-3' for APG00969, APG03128, APG00771, and 5'-PAM-target-3' for APG09748, APG09106, and APG02789.

TABLE 2

| | PAM determination | | |
|---|---|---|---|
| RGN ID | sgRNA L1 (SEQ ID NO.) | sgRNA L2 (SEQ ID NO.) | PAM (SEQ ID NO.) |
| APG00969 | 5 | 6 | 7 |
| APG03128 | 20 | 21 | 22 |
| APG09748 | 28 | 29 | 30 |
| APG00771 | 39 | 40 | 41 |
| APG02789 | 47 | 48 | 49 |
| APG09106 | 54 | 55 | 30 |

Example 4: Engineering the Guide RNA to Increase Nuclease Activity

For RGNs APG09748 and APG09106, which have very high sequence identity and have the same PAM, RNA folding predictions were used to determine regions in the guide RNA that can be altered to optimize nuclease activity. The stability of the crRNA:tracrRNA base pairing in the repeat:antirepeat region was increased by shortening the repeat:antirepeat region, adding G-C base pairs, and removing G-U wobble pairs. "Optimized" guide variants were tested and compared to the wild-type gRNA using the RGN APG09748 in in vitro cleavage assays.

To produce RGNs for RNP formation, expression plasmids containing an RGN fused to a C-terminal His6 (SEQ ID NO: 593) or His10 (SEQ ID NO: 594) tag were constructed and transformed into BL21 (DE3) strains of *E. coli*. Expression was performed using Magic Media (Thermo Fisher) supplemented with 50 µg/mL kanamycin. After lysis and clarification, the protein was purified by immobilized metal affinity chromatography and quantified using the Qubit protein quantitation kit (Thermo Fisher) or by UV-vis using a calculated extinction coefficient.

Ribonucleoprotein (RNP) was prepared by incubating the purified RGN with sgRNA at a ~2:1 ratio for 20 min at room temperature. For in vitro cleavage reactions, RNPs were incubated with plasmids or linear dsDNA containing the targeted protospacer flanked by a preferred PAM sequence for >30 min at room temperature. Two target nucleic acid sequences within the TRAC locus, TRAC11 (SEQ ID NO: 60) and TRAC14 (SEQ ID NO: 61), were tested. gRNAs were assayed both for targeted activity with the correct target nucleic acid sequence (for example, the gRNA has TRAC11 spacer sequence and the assayed target is TRAC11) and without the correct target nucleic acid sequence (for example, the gRNA has TRAC11 spacer sequence and the assayed target is TRAC14). Activity determined by plasmid cleavage is assessed by agarose gel electrophoresis. Results are shown in Table 3. Guide variants are listed as SEQ ID NOs: 56-59, and are provided with spacer sequences. These guide sequences use a noncomplementary nucleotide linker of AAAA (SEQ ID NO: 31). The optimized gRNA (SEQ ID NO: 64; poly-N indicates location of spacer sequence), with increased repeat:antirepeat binding, has optimized tracrRNA (SEQ ID NO: 62) and optimized crRNA (SEQ ID NO: 63) components. The optimized guide variant was able to cleave two loci where previously no cleavage was detected using the wild-type guide RNA. Through optimization of hybridization in the repeat:antirepeat region, in vitro cleavage of APG09748 increased from 0% cleavage to 100% cleavage for multiple targets in the TRAC locus.

TABLE 3

Editing efficiency of APG09748 with engineered guide variants

| gRNA | | | Gel 1-2 µL load | | Gel 2-1 µL load | |
|---|---|---|---|---|---|---|
| variant (SEQ ID NO.) | Guide Design | Assayed Target | % intact | % cleaved | % intact | % cleaved |
| 56 | Optimized | TRAC11 | 68 | 32 | 57 | 43 |
| 56 | Optimized | TRAC14 | 100 | 0 | 100 | 0 |
| 57 | Optimized | TRAC11 | 100 | 0 | 100 | 0 |
| 57 | Optimized | TRAC14 | 70 | 30 | 69 | 31 |
| 58 | WT | TRAC11 | 100 | 0 | 100 | 0 |
| 58 | WT | TRAC14 | 100 | 0 | 100 | 0 |
| 59 | WT | TRAC11 | 100 | 0 | 100 | 0 |
| 59 | WT | TRAC14 | 100 | 0 | 100 | 0 |
| None | | TRAC11 | 100 | 0 | 100 | 0 |
| None | | TRAC14 | 100 | 0 | 100 | 0 |

Additional optimized gRNA variants were designed and assayed. Further, different lengths of spacer sequence were also tested to determine how spacer length might affect cleavage efficiency. The sgRNA outside of the spacer sequence is referred to as the "backbone" in this assay. In Table 4, these are denoted as "WT" (SEQ ID NO: 53, the wild type sequence), and the three optimized sgRNAs: V1 (SEQ ID NO: 65), V2 (SEQ ID NO: 66) and V3 (SEQ ID NO: 64). All of these sequences have a poly-N to indicate the location of the spacer sequence. Guides were expressed as sgRNAs by in vitro transcription (IVT). Compared to the wild-type sgRNA backbone, V1 is 87.8% identical, V2 is 92.4% identical, and V3 is 85.5% identical. Synthetic tracrRNA:crRNA duplexes ("synthetic") representing dual-guide RNAs but otherwise similar to the wild type and optimized sgRNAs recited above were also produced and tested.

For this set of assays, RGN APG09106 was used; otherwise, methods for in vitro cleavage reactions were similar to what is described above. The targeted nucleic acid sequences were Target 1 (SEQ ID NO: 67) and Target 2 (SEQ ID NO: 68). The results are shown in Table 4.

TABLE 4

Editing efficiency of APG09106 with engineered guide variants

| RNA Source | Target | Spacer Length | Backbone | Spacer SEQ ID NO. | Cleavage % |
|---|---|---|---|---|---|
| Synthetic | 2 | 18 | WT | 69 | 12.3 |
| Synthetic | 1 | 20 | WT | 70 | 0 |
| Synthetic | 2 | 20 | WT | 71 | 55.0 |
| Synthetic | 1 | 25 | WT | 72 | 0 |
| Synthetic | 2 | 25 | WT | 73 | 61.4 |
| IVT | 2 | 25 | V1 | 74 | 1.1 |
| IVT | 2 | 25 | V2 | 75 | 0.9 |

TABLE 4-continued

Editing efficiency of APG09106 with engineered guide variants

| RNA Source | Target | Spacer Length | Backbone | Spacer SEQ ID NO. | Cleavage % |
|---|---|---|---|---|---|
| IVT | 2 | 25 | V3 | 76 | 0.7 |
| IVT | 2 | 20 | V3 | 77 | 21.0 |
| IVT | 1 | 25 | V3 | 78 | 2.0 |

Example 5: Demonstration of Gene Editing Activity in Mammalian Cells

Example 5.1: Activity of APG02789 in Mammalian Cells

RGN nucleotide sequences codon optimized for human expression were synthesized with an N-terminal nuclear localization tag and cloned into the pcDNA3.1 CMV expression plasmid. The final construct of the RGN polypeptide is as follows: N-terminus—SV40 NLS (SEQ ID NO: 10)—3×FLAG Tag (SEQ ID NO: 11)—RGN sequence (SEQ ID NOs: 1, 16, 24, 35, 43 or 50)—Nucleoplasmin NLS (SEQ ID NO: 12)—C-terminus. PCR amplicons comprising a U6 promoter driving expression of sgRNA sequences are generated using Herculase II (Agilent Technologies). 400 ng of RGN expression plasmids and 100 ng of the sgRNA PCR products are transfected into 24-well plates of HEK293FT cells at 75-90% confluency using Lipofectamine 2000 reagent (Life Technologies). Cells are incubated at 37° C. for 72 h post-transfection before genomic DNA extraction. Genomic DNA is extracted using the QuickExtract DNA Extraction Solution (Epicentre) following the manufacturer's protocol. The genomic region flanking the RGN target site is PCR amplified, and products are purified using QiaQuick Spin Column (Qiagen) following the manufacturer's protocol. 200-500 ng total of the purified PCR products are mixed with 1 µl 10× Taq DNA Polymerase PCR buffer (Enzymatics) and ultrapure water to a final volume of 10 µl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 min. After reannealing, products are treated with SURVEYOR nuclease and SURVEYOR enhancer S (Integrated DNA Technologies) following the manufacturer's recommended protocol and analyzed on 4-20% Novex TBE polyacrylamide gels (Life Technologies). Gels are stained with SYBR Gold DNA stain (Life Technologies) for 10 min and imaged with a Gel Doc gel imaging system (Bio-rad). Quantification is based on relative band intensities. Indel percentage was determined by the formula, $100 \times (1-(1-(b+c)/(a+b+c))^{1/2})$, where a is the integrated intensity of the undigested PCR product, and b and c are the integrated intensities of each cleavage product.

For RGN APG02789, methods were carried out as described above. A number of different genes in the human genome were targeted for RNA-guided cleavage. These loci are included in Table 5 below, along with the reference to the SEQ ID NO of the sgRNA. The indel percentage, which is an indication of RGN activity, is also shown.

TABLE 5

| Activity of APG02789 in mammalian cells | | |
|---|---|---|
| sgRNA | Gene target | % INDEL |
| 79 | DNMT1 | N.D. |
| 80 | VEGFA | N.D. |
| 81 | EMX1 | 45.6 |
| 82 | AurkB | 44.3 |
| 83 | AurkB | 31.6 |
| 84 | AurkB | 25.5 |
| 85 | HPRT1 | N.D. |
| 86 | HPRT1 | 15.7 |
| 87 | HPRT1 | N.D. |
| 88 | RelA | N.D. |
| 89 | RelA | N.D. |
| 90 | RelA | N.D. |

Example 5.2: Activity of APG09106 in Mammalian Cells

RGN expression cassettes were produced and introduced into vectors for mammalian expression. RGNs APG00969, APG03128, APG09748, APG09106, and APG02789 were each codon-optimized for human expression (SEQ ID NOs: 357-361, respectively), and the expressed proteins were operably fused at the N-terminal end to an SV40 nuclear localization sequence (NLS; SEQ ID NO: 10) and to 3×FLAG tags (SEQ ID NO: 11), and operably fused at the C-terminal end to nucleoplasmin NLS sequences (SEQ ID NO: 12). Two copies of the NLS sequence were used, operably fused in tandem. Each expression cassette was under control of a cytomegalovirus (CMV) promoter (SEQ ID NO: 334). It is known in the art that the CMV transcription enhancer (SEQ ID NO: 335) may also be included in constructs comprising the CMV promoter. Guide RNA expression constructs encoding a single gRNA each under the control of a human RNA polymerase III U6 promoter (SEQ ID NO: 336) were produced and introduced into an expression vector. Guides targeted regions of the AurkB gene. For one RNA-guided nuclease, specific residues were mutated to increase nuclease activity of the protein, specifically the T849 residue of APG09106 was mutated to arginine (SEQ ID NO: 362). This point mutation increased editing rates in mammalian cells.

The constructs described above were introduced into mammalian cells. One day prior to transfection, $1×10^5$ HEK293T cells (Sigma) were plated in 24-well dishes in Dulbecco's modified Eagle medium (DMEM) plus 10% (vol/vol) fetal bovine serum (Gibco) and 1% Penicillin-Streptomycin (Gibco). The next day when the cells were at 50-60% confluency, 500 ng of a RGN expression plasmid plus 500 ng of a single gRNA expression plasmid were co-transfected using 1.5 µL of Lipofectamine 3000 (Thermo Scientific) per well, following the manufacturer's instructions. After 48 hours of growth, total genomic DNA was harvested using a genomic DNA isolation kit (Machery-Nagel) according to the manufacturer's instructions.

The total genomic DNA was then analyzed to determine the rate of editing in the AurkB target. Oligonucleotides were produced to be used for PCR amplification and subsequent analysis of the amplified genomic target site (SEQ ID NOs: 363 and 364). All PCR reactions were performed using 10 µL of 2× Master Mix Phusion High-Fidelity DNA polymerase (Thermo Scientific) in a 20 µL reaction including 0.5 µM of each primer. Large genomic regions encompassing each target gene were first amplified using PCR #1 primers (SEQ ID NOs: 363 and 364), using a program of:

98° C., 1 min; 30 cycles of [98° C., 10 sec; 62° C., 15 sec; 72° C., 5 min]; 72° C., 5 min; 12° C., forever.

One microliter of this PCR reaction was then further amplified using primers specific for each guide (PCR #2 primers; SEQ ID NOs: 365-370), using a program of: 98° C., 1 min; 35 cycles of [98° C., 10 sec; 67° C., 15 sec; 72° C., 30 sec]; 72° C., 5 min; 12° C., forever. Primers for PCR #2 include Nextera Read 1 and Read 2 Transposase Adapter overhang sequences for Illumina sequencing.

Following the second PCR amplification, DNA was cleaned using a PCR cleanup kit (Zymo) according to the manufacturer's instructions and eluted in water. 200-500 ng of purified PCR #2 product was combined with 2 µL of 10×NEB Buffer 2 and water in a 20 µL reaction and annealed to form heteroduplex DNA using a program of: 95° C., 5 min; 95-85° C., cooled at a rate of 2° C./sec; 85-25° C., cooled at a rate of 0.1° C./sec.; 12° C., forever. Following annealing, 5 µL of DNA was removed as a no enzyme control, and 1 µL of T7 Endonuclease I (NEB) was added and the reaction incubated at 37° C. for 1 hr. After incubation, 5× FlashGel loading dye (Lonza) was added and 5 µL of each reaction and controls were analyzed by a 2.2% agarose FlashGel (Lonza) using gel electrophoresis. Following visualization of the gel, the percentage of non-homologous end joining (NHEJ) was determined using the following equation: % NHEJ events=100× [1−(1−fraction cleaved) (½)], where (fraction cleaved) is defined as: (density of digested products)/(density of digested products+undigested parental band).

For some samples, SURVEYOR® was used to analyze the results following expression in mammalian cells. Cells were incubated at 37° C. for 72 h post-transfection before genomic DNA extraction. Genomic DNA was extracted using the QuickExtract DNA Extraction Solution (Epicentre) following the manufacturer's protocol. The genomic region flanking the RGN target site was PCR amplified, and products were purified using QiaQuick Spin Column (Qiagen) following the manufacturer's protocol. 200-500 ng total of the purified PCR products were mixed with 1 µl 10× Taq DNA Polymerase PCR buffer (Enzymatics) and ultra-pure water to a final volume of 10 µl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 min.

After reannealing, products were treated with SURVEYOR® nuclease and SURVEYOR® enhancer S (Integrated DNA Technologies) following the manufacturer's recommended protocol and analyzed on 4-20% Novex TBE polyacrylamide gels (Life Technologies). Gels were stained with SYBR Gold DNA stain (Life Technologies) for 10 min and imaged with a Gel Doc gel imaging system (Bio-rad). Quantification was based on relative band intensities. Indel percentage was determined by the formula, 100× (1−(1−(b+c)/(a+b+c))½), where a is the integrated intensity of the undigested PCR product, and b and c are the integrated intensities of each cleavage product.

Additionally, products from PCR #2 containing Illumina overhang sequences underwent library preparation following the Illumina 16S Metagenomic Sequencing Library protocol. Deep sequencing was performed on an Illumina Mi-Seq platform by a service provider (MOGene). Typically, 200,000 of 250 bp paired-end reads (2×100,000 reads) are generated per amplicon. The reads were analyzed using CRISPResso (Pinello, et al. 2016 *Nature Biotech*, 34:695-697) to calculate the rates of editing. Output alignments were hand-curated to confirm insertion and deletion sites as well as identify microhomology sites at the recombination sites. The rates of editing are shown in Table 6. All experiments were performed in human cells. The "target sequence" is the targeted sequence within the gene target. For each target sequence, the guide RNA comprised the complementary RNA spacer sequence and the appropriate sgRNA depending on the RGN used. A selected breakdown of experiments by guide RNA is shown in Tables 7.1 and 7.2.

TABLE 6

Overall rates of editing for AurkB gene target

| RGN | Guide RNA ID | Target Sequence (SEQ ID NO.) | Overall Editing Rate in Sample | Deletion Rate in Sample | Insertion Rate in Sample |
|---|---|---|---|---|---|
| APG09106 | 830 | 371 | 0.55% | 100% | |
| APG09106 | 831 | 372 | 0.60% | 54% | 46% |
| APG09106 T849R | 830 | 371 | 2.97% | 98% | 2.00% |

TABLE 6-continued

Overall rates of editing for AurkB gene target

| RGN | Guide RNA ID | Target Sequence (SEQ ID NO.) | Overall Editing Rate in Sample | Deletion Rate in Sample | Insertion Rate in Sample |
|---|---|---|---|---|---|
| APG09106 T849R | 831 | 372 | 2.36% | 100% | |

Specific insertions and deletions for respective guides are shown in Tables 7.1 and 7.2. In these tables, the target sequence is identified by bold upper case letters. The 8mer PAM regions are double underlined, with the main recognized nucleotides in bold. Insertions are identified by lowercase letters. Deletions are indicated with dashes (---). The INDEL location is calculated from the PAM proximal edge of the target sequence, with the edge being location 0. The location is positive (+) if the location is on the target side of the edge; the location is negative (−) if the location is on the PAM side of the edge.

TABLE 7.1

Specific insertions and deletions for Guide 831 using RGN APG09106

| Guide | # Reads | % Reads | % of INDELs | Type | INDEL Location | Size |
|---|---|---|---|---|---|---|
| GTCTGATTGCCTGTCGTTGCCCCTCCCAGATCAT GGAGGAGTTGGCAGA (SEQ ID NO: 373) | 92294 | 99.40 | | | | |
| GTCTGATTGCCTGTCGTTGCCCCTCCCA------ --AGGAGTTGGCAGA (SEQ ID NO: 595) | 263 | 0.28 | 54.22 | Deletion | +19 | 8 |
| GTCTGATTGCCTGTCGTTGCCCctaagtgtatta agcattgtctcagagattttGGAGGAGTTGGCAG A (SEQ ID NO: 596) | 222 | 0.24 | 45.77 | Insertion | +13 | 20 |

TABLE 7.2

Specific insertions and deletions for Guide 831 using APG09106 T849R

| Guide | # Reads | % Reads | % of INDELs | Type | INDEL Location | Size |
|---|---|---|---|---|---|---|
| GTCTGATTGCCTGTCGTTGCCCCTCCCAGATCAT GGAGGAGTTGGCAGA (SEQ ID NO: 373) | 189881 | 97.64 | | | | |
| GTCTGATTGCCTGTCGTTGCCCC---------- TGGAGGAGTTGGCAGA (SEQ ID NO: 597) | 602 | 0.309 | 13.129 | Deletion | +14 | 10 |
| GTCTGATTGCCTGTCGTTGCCCCTCCCAGATC- GGAGGAGTTGGCAGA (SEQ ID NO: 598) | 394 | 0.202 | 8.593 | Deletion | +23 | 2 |
| GTCTGATTGCCTGTCGTTGCCCCTCCCAGAT--- --AGGAGTTGGCAGA (SEQ ID NO: 599) | 399 | 0.205 | 8.702 | Deletion | +22 | 5 |
| GTCTGATTGCCTGTCGTTGCCCaTC------- TG--GGAGTTGGCAGA (SEQ ID NO: 600) | 379 | 0.194 | 8.266 | Deletion & Mutation | +16 | 10 |
| GTCTGATTGCCTGTCGTTGCCCCTC-------- TGGAGGAGTTGGCAGA (SEQ ID NO: 601) | 350 | 0.179 | 7.633 | Deletion | +16 | 8 |
| GTCTGAT--------------------------- TGGAGGAGTTGGCAGA (SEQ ID NO: 602) | 309 | 0.158 | 6.739 | Deletion | −1 | 26 |
| GTCTGATTGCCTGTCGTTGCCCCTC-------- GGAGGAGTTGGCAGA (SEQ ID NO: 603) | 280 | 0.143 | 6.106 | Deletion | +16 | 9 |
| GTCTGATTGCCTGTCGTTGCCCCTCC------- aGGAGGAGTTGGCAGA (SEQ ID NO: 604) | 274 | 0.140 | 5.976 | Deletion & Mutation | +17 | 7 |

TABLE 7.2-continued

| Specific insertions and deletions for Guide 831 using APG09106 T849R | | | | | | |
|---|---|---|---|---|---|---|
| Guide | # Reads | % Reads | % of INDELs | Type | INDEL Location | Size |
| G<u>ICTGATTG</u>CCTGTCGTTGCCC------------ ---GGAGTTGGCAGA (SEQ ID NO: 605) | 251 | 0.129 | 5.474 | Deletion | +13 | 15 |
| G<u>ICTGATTG</u>CCTGTCGTTGCCC------- ATCATGGAGGAGTTGGCAGA (SEQ ID NO: 606) | 250 | 0.128 | 5.452 | Deletion | +13 | 7 |
| G<u>ICTGATTG</u>CCTGTCGTTGCCCCTC------ CATGGAGGAGTTGGCAGA (SEQ ID NO: 607) | 231 | 0.118 | 5.038 | Deletion | +16 | 6 |
| G<u>ICTGATTG</u>CCTGTCGTTGCCCCTCCCA------ ------------------------GTACT (SEQ ID NO: 608) | 218 | 0.112 | 4.754 | Deletion | +19 | 30 |
| G<u>ICTGATTG</u>CCTGTCGTTGCCCC----- aATCtTGGAGGAGTTGGCAGA (SEQ ID NO: 609) | 206 | 0.105 | 4.492 | Deletion & Mutation | +14 | 5 |
| G<u>ICTGATTG</u>CCTGTCGTTGCCC-------- TgggATGGAGGAGTTGGCAGA (SEQ ID NO: 610) | 162 | 0.083 | 3.533 | Deletion & Mutation | +13 | 8 |
| G<u>ICTGATTG</u>CCTGTCGTTGCCCCTC--------- -----AGTTGGCAGA (SEQ ID NO: 611) | 158 | 0.081 | 3.446 | Deletion | +16 | 14 |
| G<u>ICTGATTG</u>CCTGTCGTTGCCCC------- TCATGGAGGAGTTGGCAGA (SEQ ID NO: 612) | 122 | 0.062 | 2.660 | Deletion | +14 | 7 |

Example 6: Demonstration of Gene Editing Activity in Plant Cells

RNA-guided nuclease activity of an RGN of the invention is demonstrated in plant cells using protocols adapted from Li, et al., 2013 (*Nat. Biotech.* 31:688-691). Briefly, a plant codon optimized version of an RGN of the invention (SEQ ID NOs: 1, 16, 24, 35, 43 or 50) operably linked to a nucleic acid sequence encoding for an N-terminal SV40 nuclear localization signal are cloned behind the strong constitutive 35S promoter in a transient transformation vector. sgRNAs targeting one or more sites in the plant PDS gene that flank an appropriate PAM sequence are cloned behind a plant U6 promoter in a second transient expression vector. The expression vectors are introduced into *Nicotiana benthamiana* mesophyll protoplasts using PEG-mediated transformation. The transformed protoplasts are incubated in the dark for up to 36 hr. Genomic DNA is isolated from the protoplasts using a DNeasy Plant Mini Kit (Qiagen). The genomic region flanking the RGN target site is PCR amplified, and products are purified using QiaQuick Spin Column (Qiagen) following the manufacturer's protocol. 200-500 ng total of the purified PCR products are mixed with 1 μl 10× Taq DNA Polymerase PCR buffer (Enzymatics) and ultrapure water to a final volume of 10 μl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 min.

After reannealing, products are treated with SURVEYOR nuclease and SURVEYOR enhancer S (Integrated DNA Technologies) following the manufacturer's recommended protocol and analyzed on 4-20% Novex TBE polyacrylamide gels (Life Technologies). Gels are stained with SYBR Gold DNA stain (Life Technologies) for 10 min and imaged with a Gel Doc gel imaging system (Bio-rad). Quantification is based on relative band intensities. Indel percentage is determined by the formula, $100 \times (1-(1-(b+c)/(a+b+c))^{1/2})$, where a is the integrated intensity of the undigested PCR product, and b and c are the integrated intensities of each cleavage product.

Example 7: Identification of Disease Targets

A database of clinical variants was obtained from NCBI ClinVar database, which is available through the world wide web at the NCBI ClinVar website. Pathogenic Single Nucleotide Polymorphisms (SNPs) were identified from this list. Using the genomic locus information, CRISPR targets in the region overlapping and surrounding each SNP were identified. A selection of SNPs that can be corrected using base editing in combination with the RGNs of the invention to target the causal mutation ("Casl Mut.") is listed in Table 8. In Table 8, only one alias of each disease is listed. The "RS #" corresponds to the RS accession number through the SNP database at the NCBI website. The AlleleID corresponds to a causal allele accession number, and the Chromosome Accession number also provides accession reference information found through the NCBI website. Table 8 also provides genomic target sequence information suitable for the RGN listed for each disease. The target sequence information also provides protospacer sequence for the production of the necessary sgRNA for the corresponding RGN of the invention.

TABLE 8

Disease Targets for RGNs of the invention

| Disease | RS# | RGN | Cast Mut. | Allele ID | Chromosome Accession | Gene Symbol | Target (SEQ ID NO.) |
|---|---|---|---|---|---|---|---|
| ABCA4-Related Disorder | 1800553 | APG00969 | C > T | 22927 | NC_000001.10, NC_000001.11 | ABCA4 | 91 |
| ABCA4-Related Disorder | 1800553 | APG03128 | C > T | 22927 | NC_000001.10, NC_000001.11 | ABCA4 | 92 |
| Stargardt disease 1 | 1800728 | APG00969 | A > G | 98777 | NC_000001.10, NC_000001.11 | ABCA4 | 93 |
| Stargardt disease 1 | 1800728 | APG09748, APG09106, APG02789 | A > G | 98777 | NC_000001.10, NC_000001.11 | ABCA4 | 94 |
| Glycogen storage disease type 1A | 1801175 | APG09748, APG09106, APG02789 | C > T | 27037 | NC_000017.10, NC_000017.11 | G6PC | 95 |
| Severe combined immunodeficiency disease | 3218716 | APG00969 APG09748, | C > T | 52071 | NC_000014.8, NC_000014.9 | MYH7 | 96 |
| Severe combined immunodeficiency disease | 3218716 | APG09106, APG02789 | C > T | 52071 | NC_000014.8, NC_000014.9 | MYH7 | 97 |
| Hereditary cancer-predisposing syndrome | 5030818 | APG03128 | C > T | 17256 | NC_000003.11, NC_000003.12 | VHL | 98 |
| Phenylketonuria | 5030851 | APG00969 | G > A | 15628 | NC_000012.11, NC_000012.12 | PAH | 99 |
| Phenylketonuria | 5030858 | APG00969 | G > A | 15616 | NC_000012.11, NC_000012.12 | PAH | 100 |
| Phenylketonuria | 5030858 | APG09748, APG09106, APG02789 | G > A | 15616 | NC_000012.11, NC_000012.12 | PAH | 101 |
| Hyperphenyl-alaninemia | 5030860 | APG00969 | T > C | 15632 | NC_000012.11, NC_000012.12 | PAH | 102 |
| Hyperphenyl-alaninemia | 5030860 | APG03128 | T > C | 15632 | NC_000012.11, NC_000012.12 | PAH | 103 |
| Hyperphenyl-alaninemia | 5030860 | APG09748, APG09106, APG02789 | T > C | 15632 | NC_000012.11, NC_000012.12 | PAH | 104 |
| CBS-deficiency | 5742905 | APG00969 | A > G | 15159 | NC_000021.8, NC_000021.9 | CBS | 105 |
| CBS-deficiency | 5742905 | APG03128 | A > G | 15159 | NC_000021.8, NC_000021.9 | CBS | 106 |
| Congenital microcephaly | 11555217 | APG00969 | C > T | 34125 | NC_000011.9, NC_000011.10 | DHCR7 | 107 |
| Alpha-1-antitrypsin deficiency | 28929474 | APG00969 | C > T | 33006 | NC_000014.8, NC_000014.9 | SERPINA1 | 108 |
| Alpha-1-antitrypsin deficiency | 28929474 | APG03128 | C > T | 33006 | NC_000014.8, NC_000014.9 | SERPINA1 | 109 |
| Alpha-1-antitrypsin deficiency | 28929474 | APG09748, APG09106, APG02789 | C > T | 33006 | NC_000014.8, NC_000014.9 | SERPINA1 | 110 |
| Limb-girdle muscular dystrophy, type 2D | 28933693 | APG00969 | C > T | 24476 | NC_000017.10, NC_000017.11 | SGCA | 111 |
| Limb-girdle muscular dystrophy, type 2D | 28933693 | APG03128 | C > T | 24476 | NC_000017.10, NC_000017.11 | SGCA | 112 |
| Focal cortical dysplasia type II | 28934872 | APG00969 | G > A | 27436 | NC_000016.9, NC_000016.10 | TSC2 | 113 |
| Hyperimmunoglobulin D with periodic fever | 28934897 | APG00969 | G > A | 26968 | NC_000012.11, NC_000012.12 | MVK | 114 |
| Hyperimmunoglobulin D with periodic fever | 28934897 | APG03128 | G > A | 26968 | NC_000012.11, NC_000012.12 | MVK | 115 |
| MECP2-Related Disorders | 28934906 | APG00969 APG09748, | G > A | 26850 | NC_000023.10, NC_000023.11 | MECP2 | 116 |
| MECP2-Related Disorders | 28934906 | APG09106, APG02789 | G > A | 26850 | NC_000023.10, NC_000023.11 | MECP2 | 117 |
| MECP2-Related Disorders | 28935468 | APG00969 | G > A | 26863 | NC_000023.10, NC_000023.11 | MECP2 | 118 |
| MECP2-Related Disorders | 28935468 | APG00771 | G > A | 26863 | NC_000023.10, NC_000023.11 | MECP2 | 119 |
| Inclusion body myopathy 2 | 28937594 | APG00969 | A > G | 21064 | NC_000009.11, NC_000009.12 | GNE | 120 |
| Inclusion body myopathy 2 | 28937594 | APG03128 | A > G | 21064 | NC_000009.11, NC_000009.12 | GNE | 121 |
| Inclusion body myopathy 2 | 28937594 | APG09748, APG09106, APG02789 | A > G | 21064 | NC_000009.11, NC_000009.12 | GNE | 122 |
| Inclusion body myopathy 2 | 28937594 | APG00771 | A > G | 21064 | NC_000009.11, NC_000009.12 | GNE | 123 |

TABLE 8-continued

Disease Targets for RGNs of the invention

| Disease | RS# | RGN | Cast Mut. | Allele ID | Chromosome Accession | Gene Symbol | Target (SEQ ID NO.) |
|---|---|---|---|---|---|---|---|
| Congenital disorder of glycosylation | 28939378 | APG00969 | C > T | 19763 | NC_000016.9, NC_000016.10 | ALG1 | 124 |
| Familial Mediterranean fever | 28940579 | APG00969 | A > G | 17579 | NC_000016.9, NC_000016.10 | MEFV | 125 |
| Familial hyper-cholesterolemia | 28942080 | APG00969 | G > A | 18735 | NC_000019.9, NC_000019.10 | LDLR | 126 |
| Familial hyper-cholesterolemia | 28942080 | APG03128 | G > A | 18735 | NC_000019.9, NC_000019.10 | LDLR | 127 |
| MUTYH-associated polyposis | 34612342 | APG00969 | T > C | 20332 | NC_000001.10, NC_000001.11 | MUTYH | 128 |
| MUTYH-associated polyposis | 36053993 | APG00969 | C > T | 20333 | NC_000001.10, NC_000001.11 | MUTYH | 129 |
| MUTYH-associated polyposis | 36053993 | APG03128 | C > T | 20333 | NC_000001.10, NC_000001.11 | MUTYH | 130 |
| Cardiomyopathy | 36211715 | APG00969 | C > T | 29159 | NC_000014.8, NC_000014.9 | MYH7 | 131 |
| Cardiomyopathy | 36211715 | APG03128 | C > T | 29159 | NC_000014.8, NC_000014.9 | MYH7 | 132 |
| Von Willebrand disease | 41276738 | APG00969 | C > T | 15335 | NC_000012.11, NC_000012.12 | VWF | 133 |
| Von Willebrand disease | 41276738 | APG03128 | C > T | 15335 | NC_000012.11, NC_000012.12 | VWF | 134 |
| Von Willebrand disease | 41276738 | APG09748, APG09106, APG02789 | C > T | 15335 | NC_000012.11, NC_000012.12 | VWF | 135 |
| Breast and/or ovarian cancer | 41293455 | APG00969 | G > A | 32714 | NC_000017.10, NC_000017.11 | BRCA1 | 136 |
| Breast and/or ovarian cancer | 41293455 | APG09748, APG09106, APG02789 | G > A | 32714 | NC_000017.10, NC_000017.11 | BRCA1 | 137 |
| Breast and/or ovarian cancer | 41293465 | APG00969 | G > A | 70268 | NC_000017.10, NC_000017.11 | BRCA1 | 138 |
| Breast and/or ovarian cancer | 41293465 | APG03128 | G > A | 70268 | NC_000017.10, NC_000017.11 | BRCA1 | 139 |
| Breast and/or ovarian cancer | 45580035 | APG00969 | C > T | 67431 | NC_000013.10, NC_000013.11 | BRCA2 | 140 |
| Breast and colorectal cancer | 55770810 | APG00969 | G > A | 70063 | NC_000017.10, NC_000017.11 | BRCA1 | 141 |
| MECP2-Related Disorders | 61749721 | APG00969 | G > A | 26868 | NC_000023.10, NC_000023.11 | MECP2 | 142 |
| MECP2-Related Disorders | 61749721 | APG03128 | G > A | 26868 | NC_000023.10, NC_000023.11 | MECP2 | 143 |
| MECP2-Related Disorders | 61750240 | APG00969 | G > A | 26854 | NC_000023.10, NC_000023.11 | MECP2 | 144 |
| MECP2-Related Disorders | 61750240 | APG03128 | G > A | 26854 | NC_000023.10, NC_000023.11 | MECP2 | 145 |
| MECP2-Related Disorders | 61750240 | APG09748, APG09106, APG02789 | G > A | 26854 | NC_000023.10, NC_000023.11 | MECP2 | 146 |
| Stargardt disease 1 | 61751374 | APG00969 | G > A | 22933 | NC_000001.10, NC_000001.11 | ABCA4 | 147 |
| Stargardt disease 1 | 61751374 | APG03128 | G > A | 22933 | NC_000001.10, NC_000001.11 | ABCA4 | 148 |
| Familial Mediterranean fever | 61752717 | APG00969 | T > C | 17577 | NC_000016.9, NC_000016.10 | MEFV | 149 |
| MEFV-Related Disorder | 61752717 | APG09748, APG09106, APG02789 | T > C | 17577 | NC_000016.9, NC_000016.10 | MEFV | 150 |
| MEFV-Related Disorder | 61752717 | APG00771 | T > C | 17577 | NC_000016.9, NC_000016.10 | MEFV | 151 |
| Phenylketonuria | 62508698 | APG03128 | C > T | 15619 | NC_000012.11, NC_000012.12 | PAH | 152 |
| Breast and/or ovarian cancer | 62625307 | APG00969 | G > A | 69596 | NC_000017.10, NC_000017.11 | BRCA1 | 153 |
| Breast and/or ovarian cancer | 62625307 | APG03128 | G > A | 69596 | NC_000017.10, NC_000017.11 | BRCA1 | 154 |
| Breast and/or ovarian cancer | 62625307 | APG09748, APG09106, APG02789 | G > A | 69596 | NC_000017.10, NC_000017.11 | BRCA1 | 155 |
| Breast and/or ovarian cancer | 62625308 | APG00969 | G > A | 32710 | NC_000017.10, NC_000017.11 | BRCA1 | 156 |
| Breast and/or ovarian cancer | 62625308 | APG03128 | G > A | 32710 | NC_000017.10, NC_000017.11 | BRCA1 | 157 |

TABLE 8-continued

Disease Targets for RGNs of the invention

| Disease | RS# | RGN | Cast Mut. | Allele ID | Chromosome Accession | Gene Symbol | Target (SEQ ID NO.) |
|---|---|---|---|---|---|---|---|
| Breast and/or ovarian cancer | 62625308 | APG09748, APG09106, APG02789 | G > A | 32710 | NC_000017.10, NC_000017.11 | BRCA1 | 158 |
| Hereditary cancer-predisposing syndrome | 63749795 | APG09748, APG09106, APG02789 | C > T | 95218 | NC_000003.11, NC_000003.12 | MLH1 | 159 |
| Hereditary cancer-predisposing syndrome | 63749843 | APG00969 | C > T | 94826 | NC_000002.11, NC_000002.12 | MSH6 | 160 |
| Hereditary cancer-predisposing syndrome | 63749843 | APG03128 | C > T | 94826 | NC_000002.11, NC_000002.12 | MSH6 | 161 |
| Hereditary cancer-predisposing syndrome | 63749849 | APG09748, APG09106, APG02789 | C > T | 96029 | NC_000002.11, NC_000002.12 | MSH2 | 162 |
| Hereditary cancer-predisposing syndrome | 63750636 | APG00969 | C > T | 96378 | NC_000002.11, NC_000002.12 | MSH2 | 163 |
| Hereditary cancer-predisposing syndrome | 63750636 | APG03128 | C > T | 96378 | NC_000002.11, NC_000002.12 | MSH2 | 164 |
| Hereditary cancer-predisposing syndrome | 63750636 | APG09748, APG09106, APG02789 | C > T | 96378 | NC_000002.11, NC_000002.12 | MSH2 | 165 |
| Carnitine palmitoyl-transferase II deficiency | 74315294 | APG00969 | C > T | 23992 | NC_000001.10, NC_000001.11 | CPT2 | 166 |
| Carnitine palmitoyl-transferase II deficiency | 74315294 | APG09748, APG09106, APG02789 | C > T | 23992 | NC_000001.10, NC_000001.11 | CPT2 | 167 |
| Carnitine palmitoyl-transferase II deficiency | 74315294 | APG00771 | C > T | 23992 | NC_000001.10, NC_000001.11 | CPT2 | 168 |
| Cystic fibrosis | 74597325 | APG09748, APG09106, APG02789 | C > T | 22161 | NC_000007.13, NC_000007.14 | CFTR | 169 |
| RET-Related Disorders | 74799832 | APG00969 | T > C | 28958 | NC_000010.10, NC_000010.11 | RET | 170 |
| Deficiency of UDPglucose-hexose-1-phosphate uridylyltransferase | 75391579 | APG00969 | A > G | 18653 | NC_000009.11, NC_000009.12 | GALT | 171 |
| Deficiency of UDPglucose-hexose-1-phosphate uridylyltransferase | 75391579 | APG03128 | A > G | 18653 | NC_000009.11, NC_000009.12 | GALT | 172 |
| Deficiency of UDPglucose-hexose-1-phosphate uridylyltransferase | 75391579 | APG09748, APG09106, APG02789 | A > G | 18653 | NC_000009.11, NC_000009.12 | GALT | 173 |
| Cystic fibrosis | 75527207 | APG09748, APG09106, APG02789 | G > A | 22159 | NC_000007.13, NC_000007.14 | CFTR | 174 |
| Deafness, X-linked | 76434661 | APG00969 | C > T | 53916 | NC_000013.10, NC_000013.11 | GJB2 | 175 |
| Deafness, X-linked | 76434661 | APG03128 | C > T | 53916 | NC_000013.10, NC_000013.11 | GJB2 | 176 |
| Amyloidogenic transthyretin amyloidosis | 76992529 | APG00969 | G > A | 28465 | NC_000018.9, NC_000018.10 | TTR | 177 |
| Amyloidogenic transthyretin amyloidosis | 76992529 | APG03128 | G > A | 28465 | NC_000018.9, NC_000018.10 | TTR | 178 |
| Amyloidogenic transthyretin amyloidosis | 76992529 | APG09748, APG09106, APG02789 | G > A | 28465 | NC_000018.9, NC_000018.10 | TTR | 179 |
| Amyloidogenic transthyretin amyloidosis | 76992529 | APG00771 | G > A | 28465 | NC_000018.9, NC_000018.10 | TTR | 180 |
| Cystic fibrosis | 77010898 | APG00969 | G > A | 22168 | NC_000007.13, NC_000007.14 | CFTR | 181 |
| Cystic fibrosis | 77010898 | APG09748, APG09106, APG02789 | G > A | 22168 | NC_000007.13, NC_000007.14 | CFTR | 182 |
| Metachromatic leukodystrophy | 80338815 | APG00969 | C > T | 18090 | NC_000022.10, NC_000022.11 | ARSA | 183 |
| Metachromatic leukodystrophy | 80338815 | APG09748, APG09106, APG02789 | C > T | 18090 | NC_000022.10, NC_000022.11 | ARSA | 184 |
| Cowden syndrome 3 | 80338844 | APG00969 | C > T | 21935 | NC_000011.9, NC_000011.10 | SDHD | 185 |
| Cowden syndrome 3 | 80338844 | APG03128 | C > T | 21935 | NC_000011.9, NC_000011.10 | SDHD | 186 |

TABLE 8-continued

Disease Targets for RGNs of the invention

| Disease | RS# | RGN | Cast Mut. | Allele ID | Chromosome Accession | Gene Symbol | Target (SEQ ID NO.) |
|---|---|---|---|---|---|---|---|
| Cowden syndrome 3 | 80338844 | APG09748, APG09106, APG02789 | C > T | 21935 | NC_000011.9, NC_000011.10 | SDHD | 187 |
| Cowden syndrome 3 | 80338844 | APG00771 | C > T | 21935 | NC_000011.9, NC_000011.10 | SDHD | 188 |
| Smith-Lemli-Opitz syndrome | 80338853 | APG00969 | G > A | 21822 | NC_000011.9, NC_000011.10 | DHCR7 | 189 |
| Smith-Lemli-Opitz syndrome | 80338853 | APG03128 | G > A | 21822 | NC_000011.9, NC_000011.10 | DHCR7 | 190 |
| Smith-Lemli-Opitz syndrome | 80338853 | APG09748, APG09106, APG02789 | G > A | 21822 | NC_000011.9, NC_000011.10 | DHCR7 | 191 |
| Hypertyrosinemia | 80338901 | APG00969 | G > A | 26909 | NC_000015.9, NC_000015.10 | FAH | 192 |
| Hypertyrosinemia | 80338901 | APG03128 | G > A | 26909 | NC_000015.9, NC_000015.10 | FAH | 193 |
| Hypertyrosinemia | 80338901 | APG00771 | G > A | 26909 | NC_000015.9, NC_000015.10 | FAH | 194 |
| Deafness, X-linked | 80338940 | APG03128 | C > T | 32068 | NC_000013.10, NC_000013.11 | GJB2 | 195 |
| Deafness, X-linked | 80338945 | APG00969 | A > G | 32055 | NC_000013.10, NC_000013.11 | GJB2 | 196 |
| Breast and/or ovarian cancer | 80356962 | APG00969 | C > T | 70247 | NC_000017.10, NC_000017.11 | BRCA1 | 197 |
| Breast and/or ovarian cancer | 80356962 | APG03128 | C > T | 70247 | NC_000017.10, NC_000017.11 | BRCA1 | 198 |
| Breast and/or ovarian cancer | 80356962 | APG09748, APG09106, APG02789 | C > T | 70247 | NC_000017.10, NC_000017.11 | BRCA1 | 199 |
| Breast and/or ovarian cancer | 80356969 | APG03128 | G > A | 70213 | NC_000017.10, NC_000017.11 | BRCA1 | 200 |
| Breast and/or ovarian cancer | 80357123 | APG09748, APG09106, APG02789 | G > A | 70147 | NC_000017.10, NC_000017.11 | BRCA1 | 201 |
| Inborn genetic diseases | 80358259 | APG00969 | A > G | 18006 | NC_000018.9, NC_000018.10 | NPC1 | 202 |
| Inborn genetic diseases | 80358259 | APG09748, APG09106, APG02789 | A > G | 18006 | NC_000018.9, NC_000018.10 | NPC1 | 203 |
| Breast and/or ovarian cancer | 80359212 | APG00969 | C > T | 67494 | NC_000013.10, NC_000013.11 | BRCA2 | 204 |
| Breast and/or ovarian cancer | 80359212 | APG09748, APG09106, APG02789 | C > T | 67494 | NC_000013.10, NC_000013.11 | BRCA2 | 205 |
| Fanconi anemia | 104886457 | APG00969 | G > A | 27086 | NC_000009.11, NC_000009.12 | FANCC | 206 |
| Fanconi anemia | 104886457 | APG09748, APG09106, APG02789 | G > A | 27086 | NC_000009.11, NC_000009.12 | FANCC | 207 |
| SLC26A2-Related Disorders | 104893915 | APG00969 | C > T | 19128 | NC_000005.9, NC_000005.10 | SLC26A2 | 208 |
| SLC26A2-Related Disorders | 104893915 | APG03128 | C > T | 19128 | NC_000005.9, NC_000005.10 | SLC26A2 | 209 |
| SLC26A2-Related Disorders | 104893915 | APG09748, APG09106, APG02789 | C > T | 19128 | NC_000005.9, NC_000005.10 | SLC26A2 | 210 |
| Oculocutaneous albinism | 104894313 | APG00969 | C > T | 18816 | NC_000011.9, NC_000011.10 | TYR | 211 |
| Cardiomyopathy | 104894368 | APG09748, APG09106, APG02789 | C > T | 29104 | NC_000012.11, NC_000012.12 | MYL2 | 212 |
| Deafness, X-linked | 104894396 | APG09748, APG09106, APG02789 | C > T | 32041 | NC_000013.10, NC_000013.11 | GJB2 | 213 |
| Inborn genetic diseases | 104894635 | APG00969 | C > T | 20146 | NC_000017.10, NC_000017.11 | SGSH | 214 |
| Inborn genetic diseases | 104894635 | APG03128 | C > T | 20146 | NC_000017.10, NC_000017.11 | SGSH | 215 |
| Inborn genetic diseases | 104894635 | APG09748, APG09106, APG02789 | C > T | 20146 | NC_000017.10, NC_000017.11 | SGSH | 216 |

TABLE 8-continued

Disease Targets for RGNs of the invention

| Disease | RS# | RGN | Cast Mut. | Allele ID | Chromosome Accession | Gene Symbol | Target (SEQ ID NO.) |
|---|---|---|---|---|---|---|---|
| Familial Mediterranean fever | 104895097 | APG00969 | C > T | 17588 | NC_000016.9, NC_000016.10 | MEFV | 217 |
| Familial Mediterranean fever | 104895097 | APG09748, APG09106, APG02789 | C > T | 17588 | NC_000016.9, NC_000016.10 | MEFV | 218 |
| Familial Mediterranean fever | 104895097 | APG00771 | C > T | 17588 | NC_000016.9, NC_000016.10 | MEFV | 219 |
| Familial dysautonomia | 111033171 | APG09748, APG09106, APG02789 | A > G | 21124 | NC_000009.11, NC_000009.12 | ELP1 | 220 |
| Familial dysautonomia | 111033171 | APG00771 | A > G | 21124 | NC_000009.11, NC_000009.12 | ELP1 | 221 |
| Shwachman syndrome | 113993993 | APG00969 | A > G | 18235 | NC_000007.13, NC_000007.14 | SBDS | 222 |
| Shwachman syndrome | 113993993 | APG09748, APG09106, APG02789 | A > G | 18235 | NC_000007.13, NC_000007.14 | SBDS | 223 |
| POLG-related condition | 113994095 | APG00969 | C > T | 28535 | NC_000015.9, NC_000015.10 | POLG | 224 |
| POLG-related condition | 113994098 | APG00969 | C > T | 28541 | NC_000015.9, NC_000015.10 | POLG | 225 |
| POLG-related condition | 113994098 | APG03128 | C > T | 28541 | NC_000015.9, NC_000015.10 | POLG | 226 |
| Very long chain acyl-CoA dehydrogenase deficiency | 113994167 | APG00969 | T > C | 33877 | NC_000017.10, NC_000017.11 | ACADVL | 227 |
| Very long chain acyl-CoA dehydrogenase deficiency | 113994167 | APG03128 | T > C | 33877 | NC_000017.10, NC_000017.11 | ACADVL | 228 |
| Very long chain acyl-CoA dehydrogenase deficiency | 113994167 | APG00771 | T > C | 33877 | NC_000017.10, NC_000017.11 | ACADVL | 229 |
| Glycogen storage disease | 116987552 | APG00969 | G > A | 17337 | NC_000011.9, NC_000011.10 | PYGM | 230 |
| Glycogen storage disease | 116987552 | APG03128 | G > A | 17337 | NC_000011.9, NC_000011.10 | PYGM | 231 |
| Glycogen storage disease | 116987552 | APG00771 | G > A | 17337 | NC_000011.9, NC_000011.10 | PYGM | 232 |
| RYR1-Related Disorders | 118192172 | APG00969 | C > T | 28003 | NC_000019.9, NC_000019.10 | RYR1 | 233 |
| RYR1-Related Disorders | 118192172 | APG09748, APG09106, APG02789 | C > T | 28003 | NC_000019.9, NC_000019.10 | RYR1 | 234 |
| Ceroid lipofuscinosis neuronal 2 | 119455955 | APG09748, APG09106, APG02789 | G > A | 17682 | NC_000011.9, NC_000011.10 | TPP1 | 235 |
| Medium-chain acyl-coenzyme A dehydrogenase deficiency | 121434274 | APG09748, APG09106, APG02789 | G > A | 18627 | NC_000001.10, NC_000001.11 | ACADM | 236 |
| Familial hypercholesterolemia | 121908026 | APG00969 | C > T | 18725 | NC_000019.9, NC_000019.10 | LDLR | 237 |
| Familial hypercholesterolemia | 121908026 | APG03128 | C > T | 18725 | NC_000019.9, NC_000019.10 | LDLR | 238 |
| Primary hyperoxaluria | 121908529 | APG00969 | G > A | 38436 | NC_000002.11, NC_000002.12 | AGXT | 239 |
| Primary hyperoxaluria | 121908529 | APG03128 | G > A | 38436 | NC_000002.11, NC_000002.12 | AGXT | 240 |
| Primary hyperoxaluria | 121908529 | APG09748, APG09106, APG02789 | G > A | 38436 | NC_000002.11, NC_000002.12 | AGXT | 241 |
| Cardio-facio-cutaneous syndrome | 121908595 | APG00969 | A > G | 28390 | NC_000015.9, NC_000015.10 | MAP2K1 | 242 |
| Cardiomyopathy | 121908987 | APG00969 | C > T | 21885 | NC_000007.13, NC_000007.14 | PRKAG2 | 243 |
| Cardiomyopathy | 121908987 | APG09748, APG09106, APG02789 | C > T | 21885 | NC_000007.13, NC_000007.14 | PRKAG2 | 244 |
| Cowden syndrome | 121909219 | APG00969 | C > T | 22852 | NC_000010.10, NC_000010.11 | PTEN | 245 |
| Cowden syndrome | 121909219 | APG09748, APG09106, APG02789 | C > T | 22852 | NC_000010.10, NC_000010.11 | PIEN | 246 |
| FGFR3-Related Disorders | 121913482 | APG00969 | C > T | 31371 | NC_000004.11, NC_000004.12 | FGFR3 | 247 |
| FGFR3-Related Disorders | 121913482 | APG03128 | C > T | 31371 | NC_000004.11, NC_000004.12 | FGFR3 | 248 |

TABLE 8-continued

Disease Targets for RGNs of the invention

| Disease | RS# | RGN | Cast Mut. | Allele ID | Chromosome Accession | Gene Symbol | Target (SEQ ID NO.) |
|---|---|---|---|---|---|---|---|
| Cardiomyopathy | 121913625 | APG00969 | G > A | 29128 | NC_000014.8, NC_000014.9 | MYH7 | 249 |
| Cardiomyopathy | 121913628 | APG09748, APG09106, APG02789 | C > T | 29131 | NC_000014.8, NC_000014.9 | MYH7 | 250 |
| Hypophosphatasia | 121918007 | APG00969 | G > A | 28709 | NC_000001.10, NC_000001.11 | ALPL | 251 |
| Methylmalonic acidemia | 121918241 | APG00969 | C > T | 16462 | NC_000001.10, NC_000001.11 | MMACHC | 252 |
| Methylmalonic acidemia | 121918241 | APG03128 | C > T | 16462 | NC_000001.10, NC_000001.11 | MMACHC | 253 |
| Methylmalonic acidemia | 121918241 | APG00771 | C > T | 16462 | NC_000001.10, NC_000001.11 | MMACHC | 254 |
| Inborn genetic diseases | 121918243 | APG09748, APG09106, APG02789 | G > A | 16464 | NC_000001.10, NC_000001.11 | MMACHC | 255 |
| PTPN11-related disorder | 121918457 | APG00969 | C > T | 28370 | NC_000012.11, NC_000012.12 | PTPN11 | 256 |
| PTPN11-related disorder | 121918457 | APG09748, APG09106, APG02789 | C > T | 28370 | NC_000012.11, NC_000012.12 | PTPN11 | 257 |
| PTPN11-related disorder | 121918457 | APG00771 | C > T | 28370 | NC_000012.11, NC_000012.12 | PTPN11 | 258 |
| B lymphoblastic leukemia lymphoma, no ICD-O subtype | 121918459 | APG00969 | A > G | 28372 | NC_000012.11, NC_000012.12 | PTPN11 | 259 |
| Juvenile myelomono-cytic leukemia | 121918462 | APG09748, APG09106, APG02789 | C > T | 28373 | NC_000012.11, NC_000012.12 | PTPN11 | 260 |
| Juvenile myelomono-cytic leukemia | 121918466 | APG03128 | A > G | 28379 | NC_000012.11, NC_000012.12 | PTPN11 | 261 |
| Juvenile myelomono-cytic leukemia | 121918466 | APG09748, APG09106, APG02789 | A > G | 28379 | NC_000012.11, NC_000012.12 | PTPN11 | 262 |
| Juvenile myelomono-cytic leukemia | 121918466 | APG00771 | A > G | 28379 | NC_000012.11, NC_000012.12 | PTPN11 | 263 |
| Mucopoly-saccharidosis type I | 121965019 | APG00969 | G > A | 26947 | NC_000004.11, NC_000004.12 | IDUA | 264 |
| Mucopoly-saccharidosis type I | 121965019 | APG03128 | G > A | 26947 | NC_000004.11, NC_000004.12 | IDUA | 265 |
| Mucopoly-saccharidosis type I | 121965020 | APG00969 | C > T | 26948 | NC_000004.11, NC_000004.12 | IDUA | 266 |
| Mucopoly-saccharidosis type I | 121965020 | APG03128 | C > T | 26948 | NC_000004.11, NC_000004.12 | IDUA | 267 |
| Mucopoly-saccharidosis type I | 121965020 | APG09748, APG09106, APG02789 | C > T | 26948 | NC_000004.11, NC_000004.12 | IDUA | 268 |
| Ceroid lipofuscinosis neuronal 1 | 137852700 | APG00969 | G > A | 23943 | NC_000001.10, NC_000001.11 | PPT1 | 269 |
| Ceroid lipofuscinosis neuronal 1 | 137852700 | APG09748, APG09106, APG02789 | G > A | 23943 | NC_000001.10, NC_000001.11 | PPT1 | 270 |
| Polycystic kidney dysplasia | 137852944 | APG00969 | G > A | 19147 | NC_000006.11, NC_000006.12 | PKHD1 | 271 |
| CHEK2-Related Cancer Susceptibility | 137853007 | APG09748, APG09106, APG02789 | G > A | 20631 | NC_000022.10, NC_000022.11 | CHEK2 | 272 |
| Colorectal cancer | 137854568 | APG00969 | C > T | 15837 | NC_000005.9, NC_000005.10 | APC | 273 |
| Colorectal cancer | 137854568 | APG03128 | C > T | 15837 | NC_000005.9, NC_000005.10 | APC | 274 |
| Colorectal cancer | 137854568 | APG09748, APG09106, APG02789 | C > T | 15837 | NC_000005.9, NC_000005.10 | APC | 275 |
| Brugada syndrome | 137854601 | APG00969 | C > T | 24416 | NC_000003.11, NC_000003.12 | SCN5A | 276 |
| Familial hypercholesterolemia | 137929307 | APG00969 | G > A | 171217 | NC_000019.9, NC_000019.10 | LDLR | 277 |
| Familial hypercholesterolemia | 137929307 | APG09748, APG09106, APG02789 | G > A | 171217 | NC_000019.9, NC_000019.10 | LDLR | 278 |
| Spastic Paraplegia | 141659620 | APG03128 | G > A | 21858 | NC_000016.9, NC_000016.10 | SPG7 | 279 |

TABLE 8-continued

Disease Targets for RGNs of the invention

| Disease | RS# | RGN | Cast Mut. | Allele ID | Chromosome Accession | Gene Symbol | Target (SEQ ID NO.) |
|---|---|---|---|---|---|---|---|
| Cardio-facio-cutaneous syndrome | 180177035 | APG00969 | T > C | 29012 | NC_000007.13, NC_000007.14 | BRAF | 280 |
| Cardio-facio-cutaneous syndrome | 180177035 | APG09748, APG09106, APG02789 | T > C | 29012 | NC_000007.13, NC_000007.14 | BRAF | 281 |
| Cardio-facio-cutaneous syndrome | 180177035 | APG00771 | T > C | 29012 | NC_000007.13, NC_000007.14 | BRAF | 282 |
| Familial cancer of breast | 180177083 | APG00969 | G > A | 132139 | NC_000016.10, NC_000016.9 | PALB2 | 283 |
| Familial cancer of breast | 180177083 | APG09748, APG09106, APG02789 | G > A | 132139 | NC_000016.10, NC_000016.9 | PALB2 | 284 |
| MYBPC3-Related Disorders | 200411226 | APG00969 | C > T | 174776 | NC_000011.9, NC_000011.10 | MYBPC3 | 285 |
| MYBPC3-Related Disorders | 200411226 | APG03128 | C > T | 174776 | NC_000011.9, NC_000011.10 | MYBPC3 | 286 |
| MYBPC3-Related Disorders | 200411226 | APG09748, APG09106, APG02789 | C > T | 174776 | NC_000011.9, NC_000011.10 | MYBPC3 | 287 |
| MYBPC3-Related Disorders | 200411226 | APG00771 | C > T | 174776 | NC_000011.9, NC_000011.10 | MYBPC3 | 288 |
| RYR1-Related Disorders | 200563280 | APG00969 | C > T | 169564 | NC_000019.9, NC_000019.10 | RYR1 | 289 |
| RYR1-Related Disorders | 200563280 | APG09748, APG09106, APG02789 | C > T | 169564 | NC_000019.9, NC_000019.10 | RYR1 | 290 |
| Cardiomyopathy | 371898076 | APG00969 | C > T | 52045 | NC_000014.8, NC_000014.9 | MYH7 | 291 |
| Breast-ovarian cancer, familial 4 | 387906843 | APG00969 | G > A | 39241 | NC_000017.10, NC_000017.11 | RAD51D | 292 |
| Breast-ovarian cancer, familial 4 | 387906843 | APG03128 | G > A | 39241 | NC_000017.10, NC_000017.11 | RAD51D | 293 |
| MYBPC3-Related Disorders | 387907267 | APG00969 | G > A | 45725 | NC_000011.9, NC_000011.10 | MYBPC3 | 294 |
| MYBPC3-Related Disorders | 387907267 | APG03128 | G > A | 45725 | NC_000011.9, NC_000011.10 | MYBPC3 | 295 |
| MYBPC3-Related Disorders | 387907267 | APG09748, APG09106, APG02789 | G > A | 45725 | NC_000011.9, NC_000011.10 | MYBPC3 | 296 |
| PTPN11-related disorder | 397507547 | APG00969 | A > G | 49032 | NC_000012.11, NC_000012.12 | PTPN11 | 297 |
| Desmoid disease, hereditary | 397515734 | APG09748, APG09106, APG02789 | C > T | 51418 | NC_000005.9, NC_000005.10 | APC | 298 |
| Marfan Syndrome/ Loeys-Dietz Syndrome/Familial Thoracic Aortic Aneurysms and Dissections | 397515757 | APG00969 | C > T | 51454 | NC_000015.9, NC_000015.10 | FBN1 | 299 |
| Marfan Syndrome/ Loeys-Dietz Syndrome/Familial Thoracic Aortic Aneurysms and Dissections | 397515757 | APG09748, APG09106, APG02789 | C > T | 51454 | NC_000015.9, NC_000015.10 | FBN1 | 300 |
| MYBPC3-Related Disorders | 397516074 | APG00969 | C > T | 51962 | NC_000011.9, NC_000011.10 | MYBPC3 | 301 |
| MYBPC3-Related Disorders | 397516074 | APG03128 | C > T | 51962 | NC_000011.9, NC_000011.10 | MYBPC3 | 302 |
| Immuno-deficiency 14 | 397518423 | APG00969 | G > A | 94255 | NC_000001.10, NC_000001.11 | PIK3CD | 303 |
| Immuno-deficiency 14 | 397518423 | APG09748, APG09106, APG02789 | G > A | 94255 | NC_000001.10, NC_000001.11 | PIK3CD | 304 |
| Inborn genetic diseases | 398123009 | APG09748, APG09106, APG02789 | C > T | 48180 | NC_000011.9, NC_000011.10 | PACS1 | 305 |
| B lymphoblastic leukemia lymphoma, no ICD-O subtype | 529008617 | APG03128 | G > A | 152318 | NC_000001.10, NC_000001.11 | MUTYH | 306 |
| B lymphoblastic leukemia lymphoma, no ICD-O subtype | 529008617 | APG09748, APG09106, APG02789 | G > A | 152318 | NC_000001.10, NC_000001.11 | MUTYH | 307 |

TABLE 8-continued

| | | | | | | | Target |
|---|---|---|---|---|---|---|---|
| | | | | | | | (SEQ |
| | | | Cast | Allele | Chromosome | Gene | (SEQ |
| Disease | RS# | RGN | Mut. | ID | Accession | Symbol | ID NO.) |
| Familial cancer of breast | 587780021 | APG03128 | G > A | 133177 | NC_000002.11, NC_000002.12 | BARD1 | 308 |
| Familial cancer of breast | 587780021 | APG09748, APG09106, APG02789 | G > A | 133177 | NC_000002.11, NC_000002.12 | BARD1 | 309 |
| Marfan Syndrome/ Loeys-Dietz Syndrome/Familial Thoracic Aortic Aneurysm sand Dissections | 727503054 | APG00969 | A > G | 175979 | NC_000015.9, NC_000015.10 | FBN1 | 310 |
| Marfan Syndrome/ Loeys-Dietz Syndrome/Familial Thoracic Aortic Aneurysms and Dissections | 727503054 | APG03128 | A > G | 175979 | NC_000015.9, NC_000015.10 | FBN1 | 311 |
| Familial hyper-cholesterolemia | 746118995 | APG00969 | C > T | 228192 | NC_000019.9, NC_000019.10 | LDLR | 312 |
| Familial hyper-cholesterolemia | 746118995 | APG03128 | C > T | 228192 | NC_000019.9, NC_000019.10 | LDLR | 313 |
| Familial hyper-cholesterolemia | 746118995 | APG09748, APG09106, APG02789 | C > T | 228192 | NC_000019.9, NC_000019.10 | LDLR | 314 |
| Familial hyper-cholesterolemia | 746118995 | APG00771 | C > T | 228192 | NC_000019.9, NC_000019.10 | LDLR | 315 |
| Familial hyper cholesterolemia | 765696008 | APG00969 | G > A | 228162 | NC_000019.10, NC_000019.9 | LDLR | 316 |
| Familial hyper-cholesterolemia | 765696008 | APG03128 | G > A | 228162 | NC_000019.10, NC_000019.9 | LDLR | 317 |
| Familial hyper-cholesterolemia | 769370816 | APG00969 | G > A | 228176 | NC_000019.10, NC_000019.9 | LDLR | 318 |
| Familial hyper-cholesterolemia | 769370816 | APG03128 | G > A | 228176 | NC_000019.10, NC_000019.9 | LDLR | 319 |
| Familial hyper-cholesterolemia | 769370816 | APG09748, APG09106, APG02789 | G > A | 228176 | NC_000019.10, NC_000019.9 | LDLR | 320 |
| Familial hyper-cholesterolemia | 769370816 | APG00771 | G > A | 228176 | NC_000019.10, NC_000019.9 | LDLR | 321 |
| Hereditary cancer-predisposing syndrome | 786201042 | APG00969 | C > T | 181998 | NC_000002.12, NC_000002.11 | MSH6 | 322 |

Example 8: Targeting Mutations Responsible for Hurler Syndrome

The following describes a potential treatment for Hurler Syndrome, also referred to as MPS-1, using an RNA directed base editing system that corrects a mutation responsible for Hurler syndrome in a large proportion of patients with the disease. This approach utilizes a base editing fusion protein that is RNA guided and that can be packaged into a single AAV vector for delivery to a wide range of tissue types. Depending on the exact regulatory elements and base editor domain used, it may also be possible to engineer a single vector that encodes for both the base editing fusion protein and a single guide RNA to target the diseased locus.

Example 8.1: Identifying RGN with Ideal PAM

The genetic disease MPS-1 is a lysosomal storage disease characterized at the molecular level by the accumulation of dermatan sulfate and heparan sulfate in lysosomes. This disease is generally an inherited genetic disorder caused by mutations in the IDUA gene (NCBI Reference sequence NG_008103.1), which encodes α-L-iduronidase. The disease is a result of a deficiency of α-L-iduronidase. The most common IDUA mutations found in studies of individuals of Northern European background are W402X and Q70X, both nonsense mutations resulting in premature termination of translation (Bunge et al. (1994), *Hum. Mol. Genet,* 3(6): 861-866, herein incorporated by reference). Reversion of a single nucleotide would restore the wild-type coding sequence and result in protein expression controlled by the endogenous regulatory mechanisms of the genetic locus.

The W402X mutation of the human Idua gene accounts for a high proportion of MPS-1H cases. Base editors can target a narrow sequence window relative to the binding site of the protospacer component of the guide RNA and thus the presence of a PAM sequence a specific distance from the target locus is essential for the success of the strategy. Given the constraints that the target mutation must be on the exposed non-target strand (NTS) during the interaction of the base editing protein and that the footprint of the RGN domain will block access to the region near the PAM, an accessible locus is thought to be 10-30 bp from the PAM. To avoid editing and mutagenesis of other nearby adenosine bases in this window, different linkers are screened. The ideal window is 12-16 bp from the PAM.

RGN APG00969 possesses a compatible PAM sequence. APG00969 has a PAM sequence of 5'-nnARV-3' (SEQ ID NO: 7) and is compact in size—potentially allowing delivery via a single AAV vector. This delivery approach bestows multiple advantages relative to others, such as access to a wide range of tissues (liver, muscle, CNS) and well established safety profile and manufacturing techniques.

Cas9 from *S. pyogenes* (SpyCas9) requires a PAM sequence of NGG (SEQ ID NO: 323), which is present near the W402X locus, but the size of SpyCas9 prevents packaging into a single AAV vector, and thus forgoes the aforementioned advantages of this approach. While a dual delivery strategy may be employed (for example, Ryu et al, (2018), Nat. Biotechnol., 36(6): 536-539, herein incorporated by reference), it would add significant manufacturing complexity and cost. Additionally, dual viral vector delivery significantly decreases the efficiency of gene correction, since a successful edit in a given cell requires infection with both vectors and assembly of the fusion protein in the cell.

A commonly used Cas9 ortholog from *S. aureus* (SauCas9) is considerably smaller in size relative to SpyCas9, but has a more complex PAM requirement—NGRRT (SEQ ID NO: 324). This sequence, however, is not within a range expected to be useful for base editing of the causative locus.

Example 8.2: RGN Fusion Constructs and sgRNA Sequences

A DNA sequence encoding a fusion protein with the following domains is produced using standard molecular biology techniques: 1) an RGN domain with mutations that inactivate the DNA cleavage activity ("dead" or "nickase"); 2) an adenosine deaminase useful for base editing. The construct described in the table below (Table 9) comprises a fusion protein with the base editing active domain, in this example a mutated variant of APG02312 (SEQ ID NO: 325), operably fused to the N-terminal end of the dead RGN APG00969 (SEQ ID NO: 327). The base editing active domain could be any adenosine deaminase of the invention, such as for example SEQ ID NOs: 514 or 572-584. It is known in the art that a fusion protein could also be made with the base-editing enzyme at the C-terminal end of the RGN. Additionally, the RGN and the base editor of the fusion protein are typically separated by a linker amino sequence. It is known in the art that lengths of standard linkers range from 15-30 amino acids. Further, it is known in the art that certain fusion proteins between an RGN and a base-editing enzyme may also comprise at least one uracil glycosylase inhibitor (UGI) domain (SEQ ID NO: 570), which may increase base editing efficiency (U.S. Pat. No. 10,167,457, herein incorporated by reference). Therefore, a fusion protein may comprise RGN APG00969 or variant thereof, an adenosine deaminase, and optionally at least one UGI.

TABLE 9

Construct for RNA-targeted base editing

| Seq ID No. | Construct | RGN | Dead (D)or Nickase (N) | Base editor | Linker (SEQ ID NO.) |
|---|---|---|---|---|---|
| 326 | Nuc-ADAT-Linker-dAPG00969-Linker-SV40 | APG00969 | D | ADAT | 546 |

The accessible editing sites of an RGN are determined by the PAM sequence. When combining an RGN with a base editing domain, the target residue for editing must reside on the non-target strand (NTS), since the NTS is single stranded while the RGN is associated with the locus. Evaluating a number of nucleases and corresponding guide RNAs enables the selection of the most appropriate gene editing tool for this particular locus. Several potential PAM sequences that can be targeted by the constructs described above in the human Idua gene are in the proximity of the mutant nucleotide responsible for the W402X mutation. A sequence encoding a guide RNA transcript containing 1) a "spacer" that is complementary to the non-coding DNA strand at the disease locus; and 2) RNA sequence required for association of the guide RNA with the RGN is also produced. Such a sgRNA may be encoded by, for example, SEQ ID NO: 356. This sgRNA or similar sgRNAs that may be devised by one of skill in the art, can be evaluated for their efficiency in directing the base editors above or base editors with different RGN-deaminase fusions to the locus of interest.

Example 8.3: Assay for Activity in Cells from Hurler Disease Patients

To verify the genotype strategy and evaluate the constructs described above, fibroblasts from Hurler disease patients are used. A vector is designed containing appropriate promoters upstream of the fusion protein coding sequence and the sgRNA encoding sequence for expression of these in human cells, similar to those vectors described in Example 5. It is recognized that promoters and other DNA elements (for example enhancers, or terminators) which either are known for high levels of expression in human cells or may specifically express well in fibroblast cells may also be used. The vector is transfected into the fibroblasts using standard techniques, for example transfection similar to what is described in Example 5. Alternatively, electroporation may be used. The cells are cultured for 1-3 days. Genomic DNA (gDNA) is isolated using standard techniques. The editing efficiency is determined by performing a qPCR genotyping assay and/or next generation sequencing on the purified gDNA, as described further below.

Taqman™ qPCR analysis utilizes probes specific for the wild-type and mutant allele. These probes bear fluorophores which are resolved by their spectral excitation and/or emission properties using a qPCR instrument. A genotyping kit containing PCR primers and probes can be obtained commercially (i.e. Thermo Fisher Taqman™ SNP genotyping assayID C_27862753_10 for SNP ID rs121965019) or designed. An example of a designed primer and probe set is shown in Table 10.

TABLE 10

RT-PCR primers and probes

| Description | Sequence | SEQ ID NO. |
|---|---|---|
| Forward Amplification Primer | 5'-GACTCCTTCACCAAG-3' | 328 |
| Reverse Amplification Primer | 5'-GTAGATCAGCACCG-3' | 329 |
| Wild Type Probe | 5'-CTCTGGGCCGAAGT-3' | 330 |
| W402X Probe | 5'-CTCTAGGCCGAAGT-3' | 331 |

Following the editing experiment, the gDNA is subjected to qPCR analysis using standard methods and the primers and probes described above. Expected results are shown in Table 11. This in vitro system can be used to expediently evaluate constructs and choose one with high editing efficiency for further studies. The systems will be evaluated in comparison with cells with and without the W402X mutation, and preferably with some that are heterozygous for this mutation. The Ct values will be compared to either a reference gene or the total amplification of the locus using a dye such as Sybr green.

TABLE 11

Expected qPCR results

| Genotype | Transfected with base editor | Expected PCR result |
|---|---|---|
| Idua$^{WT/WT}$ | No | Homozygous WT |
| Idua$^{WT/W402X}$ | No | Heterozygous: 50% WT, 50% W402X |
| Idua$^{W402X/W402X}$ | No | Homozygous W402X |
| Idua$^{W402X/W402X}$ | Yes | Variable |

The tissues can also be analyzed by next generation sequencing. Primer binding sites such as the ones shown below (Table 12), or other suitable primer binding sites that can be identified by a person of skill in the art, can be used. Following PCR amplification, products containing Illumina Nextera XT overhang sequences undergo library preparation following the Illumina 16S Metagenomic Sequencing Library protocol. Deep sequencing is performed on an Illumina Mi-Seq platform. Typically, 200,000 of 250 bp paired-end reads (2×100,000 reads) are generated per amplicon. The reads are analyzed using CRISPResso (Pinello et al., 2016) to calculate the rates of editing. Output alignments are hand-curated to confirm insertion and deletion sites as well as identify microhomology sites at the recombination sites.

TABLE 12

NGS primer binding sites

| Direction | Sequence | SEQ ID NO. |
|---|---|---|
| Forward | 5'-ACTTCCTCCAGCC-3' | 332 |
| Reverse | 5'-GAACCCCGGCTTA-3' | 333 |

Western blotting of cell lysate of transfected cells and control cells using an anti-IDUA antibody is performed to verify expression of the full-length protein and an enzyme activity assay on the cell lysate using substrate 4-methylumbelliferyl a-L-iduronide verifies that the enzyme is catalytically active (Hopwood et al., *Clin. Chim. Acta* (1979), 92(2): 257-265, incorporated by reference herein). These experiments are performed in comparison with the original Idua$^{W402X/W402X}$ cell line (without transfection), the Idua$^{W402X/W402X}$ cell line transfected with the base editing construct and a random guide sequence, and a cell line expressing wild-type IDUA.

Example 8.4: Disease Treatment Validation in a Murine Model

To verify the efficacy of this therapeutic approach, a mouse model with a nonsense mutation in the analogous amino acid is used. The mouse strain bears a W392X mutation in its Idua gene (Gene ID: 15932) which corresponds to the homologous mutation in Hurler syndrome patients (Bunge et al., (1994), *Hum. Mol. Genet.* 3(6): 861-866, incorporated by reference herein). This locus comprises a distinct nucleotide sequence relative to that in humans, which lacks the PAM sequence necessary for correction with the base editors described in the previous examples, and thus necessitates design of a distinct fusion protein to perform the nucleotide correction. Amelioration of the disease in this animal can validate the therapeutic approach of correcting the mutation in tissues accessible by a gene delivery vector.

Mice homozygous for this mutation display a number of phenotypic characteristics similar to Hurler syndrome patients. A base editing-RGN fusion protein as described above (Table 9) along with an RNA guide sequence are incorporated into an expression vector that allows protein expression and RNA transcription in mice. A study design is shown below in Table 13. The study includes groups that are treated with a high dose of the expression vector comprising the base-editing fusion protein and RNA guide sequence, a low dose of same expression vector, control which is the model mouse treated with an expression vector that does not comprise the base editing fusion protein or the guide RNA, and a second control which is a wild type mouse treated with the same empty vector.

TABLE 13

Genome editing experiment in murine model

| Group | Mouse strain | N | Treatment |
|---|---|---|---|
| 1 | Idua-W392X[1] | ≥5 | Low dose of vector |
| 2 | Idua-W392X | ≥5 | High dose of vector |
| 3 | Idua-W392X | ≥5 | Vehicle |
| 4 | 129/Sv (WT) | 5 | Vehicle |

Endpoints to evaluate include body weight, urine GAG excretion, serum IDUA enzymatic activity, IDUA activity in tissues of interest, tissue pathology, genotyping of tissues of interest to verify correction of the SNP, and behavioral and neurological evaluation. Since some endpoints are terminal, additional groups may be added for evaluation of, for example, tissue pathology and tissue IDUA activities before the end of the study. Additional examples of endpoints can be found in published papers establishing Hurler syndrome animal models (Shull et al. (1994), *Proc. Natl. Acad. Sci. USA.*, 91(26): 12937-12941; Wang et al. (2010), *Mol. Genet. Metab.*, 99(1): 62-71; Hartung et al. (2004), *Mol. Ther.*, 9(6): 866-875; Liu et al. (2005), *Mol. Ther.*, 11(1): 35-47; Clarke et al. (1997), *Hum. Mol. Genet.* 6(4): 503-511; all herein incorporated by reference).

One possible delivery vector utilizes the adeno associated virus (AAV). A vector is produced to include a base editor-dRGN fusion protein coding sequence (for example, Nuc-ADAT-Linker-dAPG19748-Linker-SV40, as described above) preceded by a CMV enhancer (SEQ ID NO: 335) and promoter (SEQ ID NO: 334), or other suitable enhancer and promoter combination, optionally a Kozak sequence, and operably fused at the 3' end to a terminator sequence and a poly adenylation sequence such as the minimal sequence described in Levitt, N.; Briggs, D.; Gil, A.; Proudfoot, N. J. Definition of an Efficient Synthetic Poly(A) Site. *Genes Dev.* 1989, 3 (7), 1019-1025. The vector may further comprise an expression cassette encoding for a single guide RNA operably linked at its 5' end to a human U6 promoter (SEQ ID NO: 336) or another promoter suitable for production of small non-coding RNAs, and further comprising inverted terminal repeat (ITR) sequences necessary and well-known in the art for packaging into the AAV capsid. Production and viral packaging is performed by standard methods, such as those described in U.S. Pat. No. 9,587,250, herein incorporated by reference.

Other possible viral vectors include adenovirus and lentivirus vectors, which are commonly used and would contain similar elements, with different packaging capabilities and Due to the high degree of amino acid conservation, most nucleotides in the mouse locus can be altered to those of the human sequence with silent mutations as shown in Table 14. The only base changes resulting in altered coding sequence in the resulting engineered mouse genome occur after the introduced stop codon.

TABLE 14

| | Nucleotide mutations to generate a humanized mouse locus | | | | | |
|---|---|---|---|---|---|---|
| | Human (W402X) | | Mouse (W392X) | | Humanized Mouse | |
| Feature | Nucleotide (SEQ ID NO: 337) | Encoded AA (SEQ ID NOs: 614 & 615) | Nucleotide (SEQ ID NO: 338) | Encoded AA (SEQ ID NOs: 616 & 617) | Nucleotide (SEQ ID NO: 339) | Encoded AA (SEQ ID NOs: 616 & 615) |
| Protospacer | G | E | A | G | G | G |
| | G | E | G | E | G | E |
| | A | | A | | A | |
| | G | | A | | G | |
| | C | Q | C | Q | C | Q |
| | A | | A | | A | |
| | G | | A | | G | |
| | C | L | C | L | C | L |
| | T | | T | | T | |
| | C | | C | | C | |
| | T | STOP | T | STOP | T | STOP |
| | A | | A | | A | |
| | G | A | G | A | G | A |
| | G | | G | | G | |
| | C | | C | | C | |
| | C | | A | | C | |
| | G | E | G | E | G | E |
| | A | | A | | A | |
| | A | | G | | A | |
| | G | V | G | V | G | V |
| | T | | T | | T | |
| | G | | C | | G | |
| | T | S | T | S | T | S |
| | C | | C | | C | |
| | G | | A | | G | |
| PAM, non-critical | C | Q | A | K | C | Q |
| | A | | A | | A | |
| | G | | G | | G | |
| | G | A | G | A | G | A |
| PAM, critical | C | | C | | C | |
| | C | | T | | C | | requirements. Non-viral delivery methods can also be used, such as mRNA and sgRNA encapsulated by lipid nanoparticles (Cullis, P. R. and Allen, T. M. (2013), *Adv. Drug Deliv. Rev.* 65(1): 36-48; Finn et al. (2018), *Cell Rep.* 22(9): 2227-2235, both incorporated by reference), hydrodynamic injection of plasmid DNA (Suda T and Liu D, 2007, *Mol. Ther.* 15(12): 2063-2069, herein incorporated by reference), or ribonucleoprotein complexes of sgRNA and associated with gold nanoparticles (Lee, K.; Conboy, M.; Park, H. M.; Jiang, F.; Kim, H. J.; Dewitt, M. A.; Mackley, V. A.; Chang, K.; Rao, A.; Skinner, C.; et al., *Nat. Biomed. Eng.* 2017, 1 (11), 889-90).

Example 8.5: Disease Correction in a Murine Model with a Humanized Locus

To evaluate the efficacy of an identical base editor construct as would be used for human therapy, a mouse model in which the nucleotides near W392 are altered to match the sequence in humans around W402 is needed. This can be accomplished by a variety of techniques, including use of an RGN and an HDR template to cut and replace the locus in mouse embryos.

Upon engineering of this mouse strain, similar experiments will be performed as described in Example 8.4.

Example 9: Targeting Mutations Responsible for Friedreich Ataxia

The expansion of the trinucleotide repeat sequence causing Friedreich's Ataxia (FRDA) occurs in a defined genetic locus within the FXN gene, referred to as the FRDA instability region. RNA guided nucleases (RGNs) may be used for excising the instability region in FRDA patient cells. This approach requires 1) an RGN and guide RNA sequence that can be programmed to target the allele in the human genome; and 2) a delivery approach for the RGN and guide sequence. Many nucleases used for genome editing, such as the commonly used Cas9 nuclease from *S. pyogenes* (SpCas9), are too large to be packaged into adeno-associated viral (AAV) vectors, especially when considering the length of the SpCas9 gene and the guide RNA in addition to other genetic elements required for functional expression cassettes. This makes a viable approach using SpCas9 unlikely.

The compact RNA guided nucleases of the invention, particularly APG09748 and APG09106, are uniquely well suited for the excision of the FRDA instability region. Each RGN has a PAM requirement that is in the vicinity of the FRDA instability region. Additionally, each of these RGNs can be packaged into an AAV vector along with a guide RNA. Packing two guide RNAs would likely require a second vector, but this approach still compares favorably to what would be required of a larger nuclease such as SpCas9, which would require splitting the protein sequence between two vectors.

Table 15 shows the location of genomic target sequences suitable for targeting APG09748 or APG09106 to the 5' and 3' flanks of the FRDA instability region, as well as the sequence of the sgRNAs for the genomic targets. Once at the locus, the RGN would excise the FA instability region. Excision of the region can be verified with Illumina sequencing of the locus.

TABLE 15

Genomic target sequences for RGN systems

| Guide No. | Location relative to FRDA instability region | Genome target sequence (SEQ ID NO.) | sgRNA (SEQ ID NO.) |
|---|---|---|---|
| 1 | 5' | 340 | 344 |
| 2 | 5' | 341 | 345 |
| 3 | 3' | 342 | 346 |
| 4 | 3' | 343 | 347 |

Example 10: Targeting Mutations Responsible for Sickle Cell Diseases

Targeting sequences within the BCL11A enhancer region (SEQ ID NO: 348) may provide a mechanism for increasing fetal hemoglobulin (HbF) to either cure or alleviate the symptoms of sickle cell diseases. For example, genome wide association studies have identified a set of genetic variations at BCL11A that are associated with increased HbF levels. These variations are a collection of SNPs found in non-coding regions of BCL11A that function as a stage-specific, lineage-restricted enhancer region. Further investigation revealed that this BCL11A enhancer is required in erythroid cells for BCL11A expression (Bauer et al, (2013) *Science* 343:253-257, incorporated by reference herein). The enhancer region was found within intron 2 of the BCL11A gene, and three areas of DNaseI hypersensitivity (often indicative of a chromatin state that is associated with regulatory potential) in intron 2 were identified. These three areas were identified as "+62", "+58" and "+55" in accordance with the distance in kilobases from the transcription start site of BCL11A. These enhancer regions are roughly 350 (+55); 550 (+58); and 350 (+62) nucleotides in length (Bauer et al., 2013).

Example 10.1: Identifying Preferred RGN Systems

Here is described a potential treatment for beta-hemoglobinopathies using an RGN system that disrupts BCL11A binding to its binding site within the HBB locus, which is the gene responsible for making beta-globin in adult hemoglobin. This approach uses NHEJ which is more efficient in mammalian cells. In addition, this approach uses a nuclease of sufficiently small size that can be packaged into a single AAV vector for in vivo delivery.

The GATA1 enhancer motif in the human BCL11A enhancer region (SEQ ID NO: 348) is an ideal target for disruption using RNA guided nucleases (RGNs) to reduce BCL11A expression with concurrent re-expression of HbF in adult human erythrocytes (Wu et al. (2019) *Nat Med* 387:2554). Several PAM sequences compatible with APG09748 or APG09106 are readily apparent at the genetic locus surrounding this GATA1 site. These nucleases have a PAM sequence of 5'-DTTN-3' (SEQ ID NO: 30) and are compact in size, potentially allowing their delivery along with an appropriate guide RNA in a single AAV or adenoviral vector. This delivery approach bestows multiple advantages relative to others, such as access to hematopoietic stem cells and a well-established safety profile and manufacturing techniques.

The commonly used Cas9 nuclease from *S. pyogenes* (SpyCas9) requires a PAM sequence of 5'-NGG-3', (SEQ ID NO: 323) several of which are present near the GATA1 motif. However, the size of SpyCas9 prevents packaging into a single AAV or adenoviral vector and thus forgoes the aforementioned advantages of this approach. While a dual delivery strategy may be employed, it would add significant manufacturing complexity and cost. Additionally, dual viral vector delivery significantly decreases the efficiency of gene correction, since a successful edit in a given cell requires infection with both vectors.

An expression cassette encoding a human codon optimized APG09748 (SEQ ID NO: 349) or APG09106 (SEQ ID NO: 360) is produced, similar to those described in Example 5. Expression cassettes which express guide RNAs for RGNs APG09748 or APG09106 are also produced. These guide RNAs comprise: 1) a protospacer sequence that is complementary to either the non-coding or coding DNA strand within the BCL11A enhancer locus (the target sequence) and 2) an RNA sequence required for association of the guide RNA with the RGN. Because several potential PAM sequences for targeting by APG09748 or APG09106 surround the BCL11A GATA1 enhancer motif, several potential guide RNA constructs are produced to determine the best protospacer sequence that produces robust cleavage and NHEJ mediated disruption of the BCL11A GATA1 enhancer sequence. The target genomic sequences in Table 16 are evaluated to direct the RGN to this locus using the sgRNA provided in Table 16.

TABLE 16

Target Sequences for BCL11A GATA1 enhancer locus using APG09748

| Guide | Target genomic sequence (SEQ ID NO.) | sgRNA (SEQ ID NO.) |
|---|---|---|
| 1 | 350 | 353 |
| 2 | 351 | 354 |
| 3 | 352 | 355 |

To evaluate the efficiency with which APG09748 or APG09106 generates insertions or deletions that disrupt the BCL11A enhancer region, human cell lines such as human embryonic kidney cells (HEK cells) are used. A DNA vector comprising an RGN expression cassette (for example, as described in Example 5) is produced. A separate vector comprising an expression cassette comprising a coding sequence for a guide RNA sequence of Table 16 is also produced. Such an expression cassette may further comprise a human RNA polymerase III U6 promoter (SEQ ID NO: 336), as described in Example 5. Alternatively, a single vector comprising expression cassettes of both the RGN and guide RNA may be used. The vector is introduced into HEK cells using standard techniques such as those described in Example 5, and the cells are cultured for 1-3 days. Following this culture period, genomic DNA is isolated and the frequency of insertions or deletions is determined by using T7 Endonuclease I digestion and/or direct DNA sequencing, as described in Example 5.

A region of DNA encompassing the target BCL11A region is amplified by PCR with primers containing Illumina Nextera XT overhang sequences. These PCR amplicons are either examined for NHEJ formation using T7 Endonuclease I digestion, or undergo library preparation following the Illumina 16S Metagenomic Sequencing Library protocol or a similar Next Generation Sequencing (NGS) library preparation. Following deep sequencing, the reads generated are analyzed by CRISPResso to calculate rates of editing. Output alignments are hand-curated to confirm insertion and deletion sites. This analysis identifies the preferred RGN and the corresponding preferred guide RNA (sgRNA). The analysis may result in both APG09748 or APG09106 being equally preferred. Additionally, the analysis may determine there is more than one preferred guide RNA, or that all target genomic sequences in Table 16 are equally preferred.

Example 10.2: Assay for Expression of Fetal Hemoglobin

In this example, APG09748 or APG09106 generated insertions or deletions disrupting the BCL11A enhancer region are assayed for expression of fetal hemoglobin. Healthy human donor CD34$^+$ hematopoietic stem cells (HSCs) are used. These HSCs are cultured and vector(s) comprising expression cassettes comprising the coding regions of the preferred RGN and the preferred sgRNA are introduced using methods similar to those described in Example 8.3. Following electroporation, these cells are differentiated in vitro into erythrocytes using established protocols (for example, Giarratana et al. (2004) *Nat Biotechnology* 23:69-74, herein incorporated by reference). The expression of HbF is then measured using western blotting with an anti-human HbF antibody, or quantified via High Performance Liquid Chromatography (HPLC). It is expected that successful disruption of the BCL11A enhancer locus will lead to an increase in HbF production when compared to HSCs electroporated with only the RGN but no guide.

Example 10.3: Assay for Decreased Sickle Cell Formation

In this example, APG09748 or APG09106 generated insertions or deletions disrupting the BCL11A enhancer region are assayed for decreased sickle-cell formation. Donor CD34$^+$ hematopoietic stem cells (HSCs) from patients afflicted with sickle cell disease are used. These HSCs are cultured and vector(s) comprising expression cassettes comprising the coding regions of preferred RGN and the preferred sgRNA are introduced using methods similar to those described in Example 8.3. Following electroporation, these cells are differentiated in vitro into erythrocytes using established protocols (Giarratana et al. (2004) *Nat Biotechnology* 23:69-74). The expression of HbF is then measured using western blotting with an anti-human HbF antibody, or quantified via High Performance Liquid Chromatography (HPLC). It is expected that successful disruption of the BCL11A enhancer locus will lead to an increase in HbF production when compared to HSCs electroporated with only the RGN but no guide.

Sickle cell formation is induced in these differentiated erythrocytes by the addition of metabisulfite. The numbers of sickled vs normal erythrocytes are counted using a microscope. It is expected that the numbers of sickled cells are less in cells treated with APG09748 or APG09106 plus sgRNAs than with cells untreated, or treated with RGNs alone.

Example 10.4: Disease Treatment Validation in a Murine Model

To evaluate the efficacy of using APG09748 or APG09106 disruption of the BCL11A locus, suitable humanized mouse models of sickle cell anemia are used. Expression cassettes encoding for the preferred RGN and for the preferred sgRNA are packaged into AAV vectors or adenovirus vectors. In particular, adenovirus type Ad5/35 is effective at targeting HSCs. A suitable mouse model containing a humanized HBB locus with sickle cell alleles is chosen such as B6; FVB-Tg(LCR-HBA2,LCR-HBB*E26K)53Hhb/J or B6.Cg-Hbatm1Paz Hbbtm1Tow Tg(HBA-HBBs)41Paz/HhbJ. These mice are treated with granulocyte colony-stimulating factor alone or in combination with plerixafor to mobilize HSCs into circulation. AAVs or adenoviruses carrying the RGN and guide plasmid are then injected intravenously, and the mice are allowed to recover for a week. Blood obtained from these mice is tested in an in vitro sickling assay using metabisulfite, and the mice are followed longitudinally to monitor mortality rates and hematopoietic function. It is expected that treatment with AAVs or adenoviruses carrying an RGN and guide RNA will reduce sickling, mortality, and improve hematopoietic function when compared to mice treated with viruses lacking both expression cassettes, or with viruses carrying the RGN expression cassette alone.

Example 11: Identification of Deaminases

Microbial cultures were grown in liquid culture in standard laboratory media. Cultures were grown to saturation (16 to 24 hours) before DNA preparation. DNA was extracted from bacterial cells by detergent lysis, followed by binding to a silica matrix and washing with an ethanol buffer. Purified DNA was eluted from the silica matrix with a mildly alkaline aqueous buffer.

DNA for sequencing was tested for purity and concentration by spectrophotometry. Sequencing libraries were prepared using the Nextera XT library preparation kit according to the manufacturer's protocol. Sequence data was generated on a HiSeq 2000 according to the Illumina HiSeq 2000 System User Guide protocol.

Sequencing reads were assembled into draft genomes using the CLC Bio Assembly Cell software package. Following assembly, gene calls were made by several methods and resulting gene sequences were interrogated to identify novel homologs of deaminase genes. Novel genes were identified by BLAST and by domain composition. The catalytic domain D/H/C-[X]-E-[X15-45]-P-C-[X2]-C(SEQ ID NO: 613) was predicted in all enzymes. Additionally, sequences identified in the NCBI databases which are hypothetical deaminases from the genomes of sequenced eukaryotic organisms were also examined. The 268 APOBEC domain proteins identified were clustered at 65% homology, and 47 candidates were selected for deaminase activity assays. The 392 ADAT domain proteins identified were clustered at 65% homology, and further selected based on sequence length. 125 ADAT domain proteins, all of which are less than 220 amino acids in length, were selected for deaminase activity assays.

Table 17 indicates the 47 selected APOBEC domain proteins and the 125 ADAT domain proteins. The SEQ ID NO. and the APG ID, which provides the unique identification code for each polypeptide, are indicated. If available, the NCBI and Uniprot Accession Numbers are provided. "Domain Description" indicates if the deaminase possesses an ADAT or an APOBEC domain. The start and end of the ADAT or APOBEC domains within the identified polypeptide sequence are also indicated.

TABLE 17

Identified Deaminases

| SEQ ID NO. | APG ID | NCBI Accession No. | Uniprot Accession No. | Domain Description | Domain Start | Domain End |
|---|---|---|---|---|---|---|
| 374 | APG00868 | N/A | B2XR68_FELCA | APOBEC-domain | 69 | 103 |
| 375 | APG01021 | WP_003372040 | N/A | APOBEC-domain | 334 | 370 |
| 376 | APG01179 | N/A | N/A | APOBEC-domain | 137 | 170 |
| 377 | APG01180 | N/A | A0A2K6U5H6_SAIBB | APOBEC-domain | 56 | 90 |
| 378 | APG01527 | N/A | A0A2I0LXZ8_COLLI | APOBEC-domain | 63 | 95 |
| 379 | APG01650 | N/A | A0A3B3ZFB9_9GOBI | APOBEC-domain | 212 | 243 |
| 380 | APG01689 | N/A | A0A0A1X9Q9_ZEUCU | APOBEC-domain | 71 | 102 |
| 381 | APG02207 | N/A | N/A | APOBEC-domain | 321 | 357 |
| 382 | APG02282 | N/A | N/A | APOBEC-domain | 131 | 165 |
| 383 | APG02316 | WP_002598246 | N/A | APOBEC-domain | 311 | 347 |
| 384 | APG02472 | N/A | A0A1V4JAP2_PATFA | APOBEC-domain | 54 | 89 |
| 385 | APG02810 | N/A | N/A | APOBEC-domain | 131 | 164 |
| 386 | APG03038 | N/A | N/A | APOBEC-domain | 136 | 170 |
| 387 | APG03237 | N/A | A0A213GCB3_NOMLE | APOBEC-domain | 262 | 275 |
| 388 | APG03260 | N/A | N/A | APOBEC-domain | 138 | 172 |
| 389 | APG03331 | N/A | M3W3R0_FELCA | APOBEC-domain | 54 | 88 |
| 390 | APG03526 | N/A | G1RYY7 _ NOMLE | APOBEC-domain | 263 | 299 |
| 391 | APG03683 | N/A | A0A0K0MJ25_HUMAN | APOBEC-domain | 58 | 81 |
| 392 | APG03857 | N/A | U3JMS2_FICAL | APOBEC-domain | 94 | 117 |
| 393 | APG04050 | N/A | A0A340X469_LIPVE | APOBEC-domain | 267 | 301 |
| 394 | APG04117 | N/A | G1TLT9_RABIT | APOBEC-domain | 69 | 103 |
| 395 | APG04613 | N/A | A0A2R2X2H4_PTEAL | APOBEC-domain | 74 | 108 |
| 396 | APG05200 | N/A | A0A2R2X217_PTEVA | APOBEC-domain | 74 | 108 |
| 397 | APG05241 | N/A | ABEC1_MONDO | APOBEC-domain | 60 | 95 |
| 398 | APG05731 | WP_015392428 | N/A | APOBEC-domain | 316 | 352 |
| 399 | APG05840 | N/A | G8GPV9_SAGOE | APOBEC-domain | 74 | 108 |
| 400 | APG05874 | N/A | A0A2R2X212_PTEVA | APOBEC-domain | 84 | 124 |
| 401 | APG06119 | N/A | ABC3G_LAGLA | APOBEC-domain | 254 | 288 |
| 402 | APG06544 | N/A | A0A218ULD2_9PASE | APOBEC-domain | 57 | 89 |
| 403 | APG06662 | N/A | A0A2R2X213_PTEVA | APOBEC-domain | 84 | 124 |
| 404 | APG06719 | N/A | A0A2U3Y3M5_LEPWE | APOBEC-domain | 61 | 96 |
| 405 | APG07092 | N/A | N/A | APOBEC-domain | 143 | 176 |
| 406 | APG07277 | N/A | N/A | APOBEC-domain | 130 | 163 |

TABLE 17-continued

| | | | Identified Deaminases | | | |
| SEQ ID NO. | APG ID | NCBI Accession No. | Uniprot Accession No. | Domain Description | Domain Start | Domain End |
| --- | --- | --- | --- | --- | --- | --- |
| 407 | APG07280 | N/A | A0A1S3FTE2_DIPOR | APOBEC-domain | 88 | 123 |
| 408 | APG07386 | N/A | F6M3K7_MACMU | APOBEC-domain | 271 | 305 |
| 409 | APG07674 | N/A | E2RL86_CANLF | APOBEC-domain | 53 | 87 |
| 410 | APG07774 | N/A | A0A151P6M4_ALLMI | APOBEC-domain | 62 | 97 |
| 411 | APG08360 | N/A | A0A287AD63_PIG | APOBEC-domain | 81 | 115 |
| 412 | APG08501 | N/A | N/A | APOBEC-domain | 315 | 351 |
| 413 | APG08616 | N/A | A0A340WXU3_LIPVE | APOBEC-domain | 156 | 190 |
| 414 | APG09260 | N/A | A0A1S3T3Q2_SALSA | APOBEC-domain | 88 | 106 |
| 415 | APG09664 | N/A | A0A2K6NPIO_RHIRO | APOBEC-domain | 73 | 107 |
| 416 | APG09688 | N/A | G1TVM9_RABIT | APOBEC-domain | 92 | 127 |
| 417 | APG09693 | N/A | A0A2K5XQK6_MANLE | APOBEC-domain | 257 | 290 |
| 418 | APG09710 | N/A | F7EWS7_RAT | APOBEC-domain | 85 | 122 |
| 419 | APG09739 | N/A | S4RNJ9_PETMA | APOBEC-domain | 72 | 117 |
| 420 | APG09980 | N/A | A0A2R2Z4D8_PTEAL | APOBEC-domain | 68 | 102 |
| 421 | APG00835 | WP_006418834 | N/A | ADAT-domain | 64 | 97 |
| 422 | APG00921 | WP_005583886 | N/A | ADAT-domain | 58 | 91 |
| 423 | APG00970 | WP_013486656 | N/A | ADAT-domain | 58 | 91 |
| 424 | APG00990 | WP_008706930 | N/A | ADAT-domain | 62 | 95 |
| 425 | APG01340 | WP_009534123 | N/A | ADAT-domain | 89 | 122 |
| 426 | APG01499 | N/A | A0A0V0J9J5_SCHSO | ADAT-domain | 46 | 85 |
| 427 | APG01593 | N/A | N/A | ADAT-domain | 65 | 98 |
| 428 | APG01603 | WP_005610988 | N/A | ADAT-domain | 71 | 104 |
| 429 | APG01612 | N/A | N/A | ADAT-domain | 60 | 92 |
| 430 | APG01755 | N/A | H0V5A6_CAVPO | ADAT-domain | 71 | 110 |
| 431 | APG01974 | WP_011736131 | N/A | ADAT-domain | 64 | 97 |
| 432 | APG02173 | WP_003322111 | N/A | ADAT-domain | 55 | 88 |
| 433 | APG02281 | N/A | N/A | ADAT-domain | 29 | 68 |
| 434 | APG02312 | WP_016147568 | N/A | ADAT-domain | 53 | 86 |
| 435 | APG02334 | WP_011244898 | N/A | ADAT-domain | 55 | 88 |
| 436 | APG02339 | WP_005584387 | N/A | ADAT-domain | 51 | 84 |
| 437 | APG02410 | WP_009215532 | N/A | ADAT-domain | 76 | 109 |
| 438 | APG02412 | N/A | N/A | ADAT-domain | 64 | 101 |
| 439 | APG02420 | WP_015561774 | N/A | ADAT-domain | 59 | 92 |
| 440 | APG02442 | WP_017549959 | N/A | ADAT-domain | 63 | 96 |
| 441 | APG02591 | N/A | A0A2P8YEP2_BLAGE | ADAT-domain | 50 | 89 |
| 442 | APG02600 | WP_005358896 | N/A | ADAT-domain | 76 | 109 |
| 443 | APG02751 | N/A | N/A | ADAT-domain | 57 | 90 |

TABLE 17-continued

Identified Deaminases

| SEQ ID NO. | APG ID | NCBI Accession No. | Uniprot Accession No. | Domain Description | Domain Start | Domain End |
|---|---|---|---|---|---|---|
| 444 | APG02786 | WP_005997489 | N/A | ADAT-domain | 55 | 88 |
| 445 | APG02813 | WP_013282182 | N/A | ADAT-domain | 76 | 109 |
| 446 | APG03010 | WP_007203795 | N/A | ADAT-domain | 56 | 89 |
| 447 | APG03046 | N/A | N/A | ADAT-domain | 59 | 91 |
| 448 | APG03093 | WP_013270915 | N/A | ADAT-domain | 53 | 86 |
| 449 | APG03110 | WP_009677004 | N/A | ADAT-domain | 67 | 100 |
| 450 | APG03120 | WP_015923794 | N/A | ADAT-domain | 53 | 86 |
| 451 | APG03140 | WP_006701669 | N/A | ADAT-domain | 61 | 94 |
| 452 | APG03224 | WP_005353279 | N/A | ADAT-domain | 54 | 87 |
| 453 | APG03336 | N/A | N/A | ADAT-domain | 57 | 90 |
| 454 | APG03390 | N/A | R0MCR5_NOSB1 | ADAT-domain | 51 | 82 |
| 455 | APG03467 | N/A | N/A | ADAT-domain | 10 | 43 |
| 456 | APG03468 | WP_010285589 | N/A | ADAT-domain | 53 | 86 |
| 457 | APG03474 | WP_009643257 | N/A | ADAT-domain | 53 | 86 |
| 458 | APG03542 | WP_005838301 | N/A | ADAT-domain | 51 | 84 |
| 459 | APG03557 | WP_013497948 | N/A | ADAT-domain | 55 | 88 |
| 460 | APG03605 | N/A | A0A1D1XUGO_9ARAE | ADAT-domain | 61 | 103 |
| 461 | APG03691 | WP_012446504 | N/A | ADAT-domain | 57 | 90 |
| 462 | APG03856 | WP_019678962 | N/A | ADAT-domain | 52 | 85 |
| 463 | APG03876 | N/A | A0A179V3P5_BLAGS | ADAT-domain | 66 | 99 |
| 464 | APG03980 | WP_015537265 | N/A | ADAT-domain | 52 | 85 |
| 465 | APG04036 | WP_008982263 | N/A | ADAT-domain | 52 | 85 |
| 466 | APG04273 | N/A | M0RA73_RAT | ADAT-domain | 71 | 107 |
| 467 | APG04283 | WP_005999210 | N/A | ADAT-domain | 46 | 79 |
| 468 | APG04338 | WP_007506011 | N/A | ADAT-domain | 56 | 89 |
| 469 | APG04430 | WP_009220054 | N/A | ADAT-domain | 53 | 86 |
| 470 | APG04436 | WP_006908309 | N/A | ADAT-domain | 67 | 100 |
| 471 | APG04514 | N/A | N/A | ADAT-domain | 57 | 91 |
| 472 | APG04571 | WP_004636848 | N/A | ADAT-domain | 55 | 88 |
| 473 | APG04758 | N/A | N/A | ADAT-domain | 56 | 98 |
| 474 | APG04788 | N/A | A0A1C7M4C9_GRIFR | ADAT-domain | 67 | 106 |
| 475 | APG04795 | WP_016424318 | N/A | ADAT-domain | 53 | 86 |
| 476 | APG04815 | N/A | N/A | ADAT-domain | 43 | 75 |
| 477 | APG04852 | N/A | N/A | ADAT-domain | 69 | 102 |
| 478 | APG04968 | WP_012157903 | N/A | ADAT-domain | 53 | 86 |
| 479 | APG05022 | WP_006785792 | N/A | ADAT-domain | 52 | 85 |

TABLE 17-continued

| | | | Identified Deaminases | | | |
|---|---|---|---|---|---|---|
| SEQ ID NO. | APG ID | NCBI Accession No. | Uniprot Accession No. | Domain Description | Domain Start | Domain End |
| 480 | APG05211 | WP_002441139 | N/A | ADAT-domain | 53 | 86 |
| 481 | APG05314 | WP_008301499 | N/A | ADAT-domain | 66 | 99 |
| 482 | APG05320 | WP_004832879 | N/A | ADAT-domain | 53 | 86 |
| 483 | APG05415 | WP_013171002 | N/A | ADAT-domain | 58 | 91 |
| 484 | APG05461 | WP_008909404 | N/A | ADAT-domain | 52 | 85 |
| 485 | APG05486 | WP_018131372 | N/A | ADAT-domain | 100 | 133 |
| 486 | APG05507 | WP_009061460 | N/A | ADAT-domain | 56 | 89 |
| 487 | APG05573 | N/A | N/A | ADAT-domain | 55 | 94 |
| 488 | APG05582 | N/A | A0A2U4CP64_TURTR | ADAT-domain | 71 | 110 |
| 489 | APG05694 | WP_008590218 | N/A | ADAT-domain | 53 | 86 |
| 490 | APG05703 | N/A | N/A | ADAT-domain | 43 | 75 |
| 491 | APG05759 | N/A | A0A1V4M A3_PATFA | ADAT-domain | 57 | 96 |
| 492 | APG05844 | WP_013248301 | N/A | ADAT-domain | 57 | 90 |
| 493 | APG05922 | N/A | N/A | ADAT-domain | 44 | 98 |
| 494 | APG06120 | WP_005841945 | N/A | ADAT-domain | 54 | 87 |
| 495 | APG06219 | N/A | N/A | ADAT-domain | 4 | 53 |
| 496 | APG06225 | N/A | N/A | ADAT-domain | 46 | 79 |
| 497 | APG06334 | WP_014116671 | N/A | ADAT-domain | 52 | 85 |
| 498 | APG06393 | WP_005489257 | N/A | ADAT-domain | 53 | 86 |
| 499 | APG06572 | WP_011339999 | N/A | ADAT-domain | 46 | 79 |
| 500 | APG06638 | WP_006875450 | N/A | ADAT-domain | 52 | 85 |
| 501 | APG06645 | WP_013656057 | N/A | ADAT-domain | 53 | 86 |
| 502 | APG06703 | N/A | V8NRA1_OPHHA | ADAT-domain | 24 | 63 |
| 503 | APG06776 | WP_003147612 | N/A | ADAT-domain | 53 | 86 |
| 504 | APG06861 | WP_010624847 | N/A | ADAT-domain | 59 | 92 |
| 505 | APG06951 | WP_012809557 | N/A | ADAT-domain | 56 | 89 |
| 506 | APG06953 | N/A | A0A0A9Y1X6_LYGHE | ADAT-domain | 54 | 88 |
| 507 | APG06973 | WP_010630866 | N/A | ADAT-domain | 86 | 119 |
| 508 | APG07045 | N/A | N/A | ADAT-domain | 67 | 100 |
| 509 | APG07128 | WP_005345192 | N/A | ADAT-domain | 61 | 94 |
| 510 | APG07164 | WP_006525269 | N/A | ADAT-domain | 53 | 86 |
| 511 | APG07264 | WP_013276874 | N/A | ADAT-domain | 55 | 88 |
| 512 | APG07331 | WP_012939070 | N/A | ADAT-domain | 63 | 96 |
| 513 | APG07449 | N/A | ADAT2_DANRE | ADAT-domain | 70 | 109 |
| 514 | APG07458 | WP_004035644 | N/A | ADAT-domain | 53 | 86 |
| 515 | APG07614 | WP_009015861 | N/A | ADAT-domain | 57 | 90 |

TABLE 17-continued

| | | | Identified Deaminases | | | |
|---|---|---|---|---|---|---|
| SEQ ID NO. | APG ID | NCBI Accession No. | Uniprot Accession No. | Domain Description | Domain Start | Domain End |
| 516 | APG07667 | N/A | N/A | ADAT-domain | 61 | 94 |
| 517 | APG07706 | N/A | Q16JL7_AEDAE | ADAT-domain | 60 | 99 |
| 518 | APG07733 | WP_011345539 | N/A | ADAT-domain | 52 | 85 |
| 519 | APG07861 | N/A | A0A1X0QE95_9MICR | ADAT-domain | 54 | 86 |
| 520 | APG07900 | WP_019468226 | N/A | ADAT-domain | 53 | 86 |
| 521 | APG07952 | WP_017471628 | N/A | ADAT-domain | 52 | 85 |
| 522 | APG07964 | N/A | N/A | ADAT-domain | 57 | 87 |
| 523 | APG07975 | N/A | N/A | ADAT-domain | 71 | 137 |
| 524 | APG08010 | WP_016475938 | N/A | ADAT-domain | 69 | 102 |
| 525 | APG08054 | WP_015357810 | N/A | ADAT-domain | 51 | 84 |
| 526 | APG08311 | WP_013485444 | N/A | ADAT-domain | 58 | 91 |
| 527 | APG08447 | WP_015912349 | N/A | ADAT-domain | 52 | 85 |
| 528 | APG08494 | WP_013779369 | N/A | ADAT-domain | 59 | 92 |
| 529 | APG08613 | N/A | A0A1S9RJZ5_9EURO | ADAT-domain | 69 | 102 |
| 530 | APG08766 | N/A | A0A034WM03_BACDO | ADAT-domain | 71 | 110 |
| 531 | APG08799 | WP_002835051 | N/A | ADAT-domain | 54 | 87 |
| 532 | APG08810 | N/A | N/A | ADAT-domain | 58 | 97 |
| 533 | APG08893 | WP_014394804 | N/A | ADAT-domain | 53 | 86 |
| 534 | APG08939 | WP_004098361 | N/A | ADAT-domain | 56 | 89 |
| 535 | APG08952 | WP_006789980 | N/A | ADAT-domain | 53 | 86 |
| 536 | APG08955 | WP_014969075 | N/A | ADAT-domain | 53 | 86 |
| 537 | APG09011 | WP_011937002 | N/A | ADAT-domain | 71 | 104 |
| 538 | APG09180 | WP_007222730 | N/A | ADAT-domain | 57 | 90 |
| 539 | APG09204 | WP_006588115 | N/A | ADAT-domain | 57 | 90 |
| 540 | APG09216 | WP_019878409 | N/A | ADAT-domain | 56 | 89 |
| 541 | APG09352 | WP_015558044 | N/A | ADAT-domain | 54 | 87 |
| 542 | APG09356 | WP_018923319 | N/A | ADAT-domain | 54 | 87 |
| 543 | APG09546 | WP_009796283 | N/A | ADAT-domain | 61 | 94 |
| 544 | APG09753 | N/A | N/A | ADAT-domain | 29 | 70 |
| 545 | APG09981 | N/A | N/A | ADAT-domain | 83 | 116 |

Example 12: Assay for Deaminase Activity

Example 12.1: Selection of Putative Deaminases

The coding sequences of the selected proteins shown in Table 17 were codon-optimized for expression in bacteria, synthesized, and introduced into standard bacterial expression vectors well-known in the art, operably linked at the 5' end to the T7 promoter.

Example 12.2: Deaminase Activity Assays

The deaminase activity assay is based on Garibyan et al. (DNA Repair 2: 593-608, 2003). Mutations in the rpoB gene of Escherichia coli result in resistance to the antibiotic rifampicin (Rif) by altering the β subunit of RNA polymerase.

A bacterial expression vector encoding for a putative deaminase, as described in Example 12.1, was introduced into T7 Express E. coli cells (NEBioLabs). The cells may also contain a separate expression plasmid encoding for Uracil DNA glycosylase inhibitor (UGI; SEQ ID NO: 570) and for a carbenicillin selectable marker. The cells were grown to saturation and then used as a source for inoculum of a self-inducing media (MagicMedia™, Thermo Fisher Scientific), and then grown for an additional 5 hours. Cells were dilution-plated on LB with kanamycin or LB with kanamycin and carbenicillin, depending on if they also contained the UGI expression plasmid. These dilution-plates were used to get a total cell count. The same cells were also plated on LB with rifampicin or LB with rifampicin and carbenicillin to identify putative deaminase expression vectors which were able to successfully introduce mutations into the rpoB gene.

Deaminase expression vectors were isolated from bacterial colonies which grew on the LB plates containing rifampicin, and the assay was repeated at least twice. Following confirmation, the bacterial cells were sequenced. Unexpectedly, of the 47 APOBEC domain containing proteins selected for evaluation, only nine showed deaminase activity. Of the 125 ADAT domain containing proteins selected for evaluation, none showed deaminase activity. This suggests that deaminase activity cannot be predicted based on the amino acid sequence of the polypeptide, but instead must be empirically determined. Results for the nine active deaminases identified by this assay are shown in Table 18. The rpoB gene from the rifampicin-resistant colonies was sequenced to identify the induced mutations. The mutation rate was calculated by taking the number of resistant colonies comprising each active deaminase compared to the total number of colonies.

TABLE 18

| NGS analysis of mutation rate of active deaminases | | |
| --- | --- | --- |
| APG ID | SEQ ID NO. | Mutation Rate |
| APG05241 | 397 | 42% |
| APG07280 | 407 | 36.90% |
| APG09260 | 414 | 35.30% |
| APG08360 | 411 | 36.90% |
| APG09980 | 420 | 30.50% |
| APG07386 | 408 | 36.80% |
| APG09688 | 416 | 19.20% |
| APG05840 | 399 | 25.80% |
| APG02316 | 383 | 48.40% |

Example 13: Base Editing Activity in Bacterial Cells

APG00868 (SEQ ID NO: 374) was also identified as an active deaminase in a subsequent activity screen. Coding sequences of the ten identified active deaminases were introduced into an expression cassette which produces a fusion protein comprising an NLS at its N-terminal end (SEQ ID NO: 10) operably linked at its C-terminal end to an active deaminase of Table 18, operably linked at its C-terminal end to a linker sequence (SEQ ID NO: 546), operably linked at its C-terminal end to a RNA-guided, DNA binding protein, namely a nuclease-inactive RNA-guided nuclease (RGN) dAPG08290.1 variant (SEQ ID NO: 547), operably linked at its C-terminal end to a second NLS, operably linked at its C-terminal end to a TEV site (SEQ ID NO: 548), operably linked at its C-terminal end to a 10× His (SEQ ID NO 594) tag. Selected deaminases identified in Example 12 and APG00868 were assayed for targeted base editing activity in bacterial cells.

This activity assay was very similar to Example 12. However, for these experiments the deaminases were linked to an inactive RGN, to enable targeting to a particular region of the rpoB gene to introduce targeted C to T mutations. Additionally, vectors comprising expression cassettes capable of expressing guide RNAs for targeting of the RGN-deaminase fusion were produced. Four different guide RNAs were used in these experiments. The first guide, referred to in Table 19 as "untargeted" (SEQ ID NO: 549), guided the RGN-deaminase fusion to a region of genomic bacterial DNA that was not the rpoB gene. Target 1 (SEQ ID NO: 550) was to a region of the rpoB gene that would introduce an R529C mutation in the rpoB protein. Target 2 (SEQ ID NO: 551) was to a region of the rpoB gene that would introduce an A532V mutation in the rpoB protein, and Target 3 (SEQ ID NO: 552) was to a region of the rpoB gene that would introduce a Q513R mutation in the rpoB protein. The desired mutations of targets 1 and 2 would be a result of base editing from a GC pair to an AT pair. The desired mutation of target 3 would be a result of base editing from an AT pair to a GC pair. Other possible mutations also can be found in these targets.

The fusion protein expression vectors, along with vectors comprising expression cassettes capable of expressing guide RNAs that targeted to locations of interest on the rpoB gene, were introduced into T7 Express E. coli cells (NEBioLabs). The cells were grown to saturation and then used as a source for inoculum of a self-inducing media (MagicMedia™, Thermo Fisher Scientific), and then grown for an additional 5 hours. Cells were dilution-plated on LB with kanamycin; these dilution-plates were used to get a total cell count. The same cells were also plated on LB with rifampicin to identify colonies which carried mutations in the rpoB gene. Mutation rates for the "untargeted" and for the targeted deaminase-RGN fusion proteins ("targeted") were calculated and are shown in Table 19. The percent increase ("% increase") in the mutation rate of the targeted deaminase-RGN fusions compared to the deaminase-RGN fusions not targeted to the rpoB gene is also indicated in Table 19. A positive control mammalian APOBEC known to function as a deaminase was also included.

TABLE 19

| Mutation rates of targeted and untargeted deaminases | | | | |
| --- | --- | --- | --- | --- |
| Deaminase APG ID | Type of Guide RNA | Target (SEQ ID NO.) | Mutation rate | % Increase |
| APG05241 | Untargeted | 549 | 1.71*10−8 | — |
| APG05241 | Targeted | 550 | 1.42*10−7 | 8.31 |
| APG05241 | Targeted | 551 | 5.95*10−9 | 0.35 |
| APG05241 | Targeted | 552 | 3.62*10−8 | 2.12 |
| APG08360 | Untargeted | 549 | 4.00*10−11 | — |
| APG08360 | Targeted | 550 | 4.74*10−10 | 11.84 |
| APG08360 | Targeted | 551 | 2.38*10−11 | 0.60 |
| APG08360 | Targeted | 552 | 4.70*10−8 | 2175.00 |
| APG00868 | Untargeted | 549 | 1.82*10−9 | — |
| APG00868 | Targeted | 550 | 1.43*10−7 | 78.68 |
| APG00868 | Targeted | 551 | 3.79*10−9 | 2.09 |
| APG00868 | Targeted | 552 | 1.18*10−6 | 650.00 |
| control | Untargeted | 549 | 1.53*10−8 | — |
| control | Targeted | 550 | 6.37*10−6 | 417.36 |
| control | Targeted | 551 | 2.59*10−7 | 16.98 |
| control | Targeted | 552 | 3.79−10−7 | 24.86 |

Example 14: Base Editing Activity in Mammalian Cells

Coding sequences of the identified active deaminases were codon-optimized for expression in mammalian cells and introduced into an expression cassette which produces a fusion protein comprising an NLS at its N-terminal end (SEQ ID NO: 10), operably linked at its C-terminal end to a 3×FLAG tag (SEQ ID NO: 11), operably linked at its C-terminal end to a deaminase of the invention, operably linked at its C-terminal end to an amino acid linker (SEQ ID NO: 546), operably linked at its C-terminal end to an RNA-guided, DNA-binding polypeptide, namely an RGN which has been mutated to function as a nickase (nAPG07433.1; SEQ ID NO: 553), operably linked at its C-terminal end to a second NLS. Additionally, N-terminal and C-terminal fragments of APG07386 (APG07386-NTD as SEQ ID NO: 554 and APG07386-CTD as-SEQ ID NO: 555, respectively) were individually introduced into an expression cassette to produce deaminase-RGN fusions of each fragment. These expression cassettes were each introduced into a vector capable of driving expression of the fusion protein in mammalian cells. Vectors were also produced that were capable of expressing guide RNAs to target the deaminase-RGN fusion protein to a determined genomic location. These guide RNAs are capable of guiding the deaminase-RGN fusion protein to a targeted genomic sequence for base editing. SEQ ID NOs: 556-561 encode the guide RNAs tested.

Example 14.1: Efficiencies and Sequence Specificity Amongst Deaminases

Vectors capable of expressing the deaminase-RGN fusion proteins and guide RNAs described above were transfected into HEK293T cells, using either lipofection or electroporation. For lipofection, cells were seeded at $1\times10^5$ cells/well in 24-well plates the day prior to transfection in growth medium (DMEM+10% Fetal Bovine Serum+1% Penicillin/streptomycin). 500 ng of the deaminase-RGN fusion expression vector and 1 μg of the guide RNA expression vector were transfected using Lipofectamine® 3000 reagent (Thermo Fisher Scientific) following manufacturer's instructions. For electroporation, cells were electroporated using the Neon® Transfection System (Thermo Fisher Scientific) following manufacturer's instructions.

24-48 hours after lipofection or electroporation, genomic DNA was harvested from the transfected or electroporated cells and the DNA was sequenced and analyzed for the presence of the targeted base-editing mutations.

Table 20 below shows the editing rates of cytidine bases for each deaminase, including for the C-terminal and N-terminal fragments of APG07386. The number line indicates the position of the cytidine base in the targeted genomic sequence relative to the PAM of the RGN. The rate of editing of C nucleotides at each position is shown as an average of multiple targets. The number of targets (n) is listed for each position underneath the column. The standard deviation is shown in parenthesis. In this assay, APG09980, APG07386-CTD, APG05840, APG05241, APG07280, APG09688 and APG00868 show at least some level of cytidine base editing activity of at least one cytidine.

TABLE 20

| | Editing rate of C nucleotides in mammalian cells | | | | | | | | | |
|---|---|---|---|---|---|---|---|---|---|---|
| | Position in Target | | | | | | | | | |
| APG ID | 1 | 2 | 3 | 4 | 5 | 6 | 7 | 8 | 9 | 10 |
| APG05241 | 0% | 0.1% | 0.25% | 1.367% | — | 0.4% | 6.55% | 6.4% | 4.7% | 5.9% |
| | (0) | (0.17) | (0.35) | (1.72) | | (0) | (12.04) | (8.63) | (0) | (3.54) |
| APG07280 | 0% | 0.08% | 0% | 0.067% | — | 0% | 1.675% | 6.45% | 0.5% | 1.15% |
| | (0) | (0.18) | (0) | (0.12) | | (0) | (2.56) | (9.12) | (0) | (1.2) |
| APG09260 | 0% | 0% | 0% | 0% | — | 0% | 0.075% | 0.05% | 0% | 0% |
| | (0) | (0) | (0) | (0) | | (0) | (0.05) | (0.07) | (0) | (0) |
| APG08360 | 0% | 0.02% | 0% | 0.167% | — | 0% | 0.025% | 0% | 1.4% | 0% |
| | (0) | (0.04) | (0) | (0.29) | | (0) | (0.05) | (0) | (0) | (0) |
| APG09980 | 0% | 0.1% | 0% | 1.267% | — | 16% | 12.875% | 8.55% | 6.9% | 5.7% |
| | (0) | (0.22) | (0) | (1.36) | | (0) | (10.43) | (8.41) | (0) | (5.8) |
| APG07386 | 0% | 0% | 0% | 1.033% | — | 0% | 0.025% | 0.4% | 6.6% | 0.25% |
| | (0) | (0) | (0) | (1.79) | | (0) | (0.05) | (0) | (0) | (0.35) |
| APG07386-CTD | 0% | 0.2% | 0.6% | 2.233% | — | 1.3% | 2.15% | 1.95% | 21.1% | 2.35% |
| | (0) | (0.45) | (0.85) | (3.44) | | (0) | (2.9) | (0.21) | (0) | (1.34) |
| APG07386-NTD | 0% | 0% | 0% | 0% | — | 0.1% | 0.175% | 0.45% | 0% | 0% |
| | (0) | (0) | (0) | (0) | | (0) | (0.29) | (0.64) | (0) | (0) |
| APG09688 | 0% | 0.02% | 0% | 0.267% | — | 0% | 1.1% | 9.5% | 0.6% | 0.2% |
| | (0) | (0.04) | (0) | (0.46) | | (0) | (1.87) | (13.44) | (0) | (0) |
| APG05840 | 0% | 0.1% | 0.15% | 0.167% | — | 15.3% | 10.475% | 13.25% | 7.1% | 16.7% |
| | (0) | (0.22) | (0.21) | (0.29) | | (0) | (10.9) | (11.1) | (0) | (6.93) |
| APG02316 | 0.1% | 0.02% | 0% | 0% | — | 0.1% | 0.075% | 0.1% | 0% | 0% |
| | (0) | (0.04) | (0) | (0) | | (0) | (0.05) | (0.14) | (0) | (0) |
| APG00868 | 0% | 0.2% | 0.15% | 0.967% | — | 29.4% | 22.85% | 8.4% | 7.4% | 4% |
| | (0) | (0.39) | (0.21) | (1.34) | | (0) | (7.35) | (2.12) | (0) | (2.69) |
| control 1 | 0.1% | 0.12% | 0% | 0.567% | — | 0.3% | 3.25% | 13.65% | 0% | 2.5% |
| | (0) | (0.22) | (0) | (0.9) | | (0) | (5.84) | (19.02) | (0) | (3.11) |
| control 2 | 0% | 0.52% | 0% | 0.7% | — | 37.2% | 12.75% | 10.1% | 1.8% | 7.45% |
| | (0) | (0.52) | (0) | (0.89) | | (0) | (5.71) | (9.9) | (0) | (8.84) |
| No. of targets | n = 1 | n = 5 | n = 2 | n = 3 | n = 0 | n = 1 | n = 4 | n = 2 | n = 1 | n = 2 |

| | Position in Target | | | | | | | | | |
|---|---|---|---|---|---|---|---|---|---|---|
| APG ID | 11 | 12 | 13 | 14 | 15 | 16 | 17 | 18 | 19 | 20 |
| APG05241 | 1.1% | 0% | 22.3% | 0% | 12.5% | 0% | 15% | 0.4% | 0.1% | 1.225% |
| | (1.56) | (0) | (0) | (0) | (16.4) | (0) | (0) | (0.57) | (0.14) | (1.8) |

TABLE 20-continued

| | | | | Editing rate of C nucleotides in mammalian cells | | | | | |
|---|---|---|---|---|---|---|---|---|---|
| APG07280 | 0% | 0% | 13.9% | 0% | 12.95% | 0% | 7.5% | 0.25% | 0.1% | 1.575% |
| | (0) | (0) | (0) | (0) | (16.33) | (0) | (0) | (0.35) | (0.14) | (2.36) |
| APG09260 | 0% | 0% | 0% | 0% | 0% | 0% | 0% | 0% | 0.1% | 0% |
| | (0) | (0) | (0) | (0) | (0) | (0) | (0) | (0) | (0.14) | (0) |
| APG08360 | 0% | 0% | 0.7% | 0% | 4.65% | 0% | 6.3% | 0.7% | 0.05% | 1.75% |
| | (0) | (0) | (0) | (0) | (6.43) | (0) | (0) | (0.99) | (0.07) | (3.18) |
| APG09980 | 0% | 0% | 21.1% | 3.4% | 12.4% | 0% | 11.1% | 1.5% | 0% | 1.375% |
| | (0) | (0) | (0) | (0) | (17.11) | (0) | (0) | (2.12) | (0) | (2.55) |
| APG07386 | 0.65% | 0% | 6.3% | 0% | 11.25% | 3.2% | 4.1% | 1.7% | 0% | 2.925% |
| | (0.92) | (0) | (0) | (0) | (13.93) | (0) | (0) | (2.4) | (0) | (4.22) |
| APG07386-CTD | 5.4% | 0% | 21.8% | 0% | 23.3% | 2.1% | 8.8% | 3.25% | 0% | 1.125% |
| | (2.69) | (0) | (0) | (0) | (24.89) | (0) | (0) | (4.6) | (0) | (1.37) |
| APG07386-NTD | 0% | 0% | 0% | 0% | 0% | 0% | 0.9% | 0% | 0% | 0% |
| | (0) | (0) | (0) | (0) | (0) | (0) | (0) | (0) | (0) | (0) |
| APG09688 | 0% | 0% | 21.9% | 0% | 19.95% | 0% | 10.6% | 0.4% | 0% | 1.325% |
| | (0) | (0) | (0) | (0) | (28.07) | (0) | (0) | (0.57) | (0) | (2.32) |
| APG05840 | 1.8% | 4% | 19.1% | 12.5% | 18.9% | 4.2% | 29.2% | 3.5% | 0% | 2.825% |
| | (0.42) | (0) | (0) | (0) | (8.06) | (0) | (0) | (2.55) | (0) | (2.84) |
| APG02316 | 0% | 0% | 3.6% | 0% | 0% | 0% | 0% | 0% | 0% | 0.025% |
| | (0) | (0) | (0) | (0) | (0) | (0) | (0) | (0) | (0) | (0.05) |
| APG00868 | 7.8% | 14.6% | 4.6% | 6.2% | 9.3% | 2.7% | 12.8% | 1.85% | 5.3% | 2% |
| | (0.99) | (0) | (0) | (0) | (5.8) | (0) | (0) | (1.63) | (1.7) | (1.45) |
| control 1 | 3.15% | 0% | 35% | 9.1% | 18.45% | 0% | 28.6% | 1.55% | 1.4% | 2.375% |
| | (4.17) | (0) | (0) | (0) | (24.25) | (0) | (0) | (1.63) | (1.98) | (3.39) |
| control 2 | 0.95% | 40.6% | 2.8% | 14.5% | 3.6% | 0.7% | 4.6% | 1% | 0.65% | 1.425% |
| | (0.07) | (0) | (0) | (0) | (0.71) | (0) | (0) | (0.57) | (0.92) | (0.98) |
| No. of targets | n = 2 | n = 1 | n = 1 | n = 1 | n = 2 | n = 1 | n = 1 | n = 2 | n = 2 | n = 4 |

Example 14.2: Fluorescence Assay for Targeted Base Editing

A vector harboring Enhanced Green Fluorescent Protein (EGFP) containing a Y66H mutation which causes a fluorescence shift to blue fluorescent protein (BFP, SEQ ID NO: 562) was constructed such that the H66 codon can be reverted from histidine (CAT) to the wildtype tyrosine (TAT) residue using a cytosine deaminase to alter the first position C to T. Successful C to T conversion results in the expression of EGFP which can be quantified. A second vector capable of expressing a guide RNA which targets the deaminase-RGN fusion protein to the region around the Y66H mutation (SEQ ID NO: 563) was also produced.

This BFP to EGFP reporter vector, along with the vectors capable of expressing the deaminase-RGN fusion protein and the guide RNA, were transfected into HEK293T cells, using either lipofection or electroporation. For lipofection, cells were seeded at $1 \times 10^5$ cells/well in 24-well plates the day prior to transfection in growth medium (DMEM+10% Fetal Bovine Serum+1% Penicillin/streptomycin). 500 ng each of the BFP reporter vector, deaminase-RGN expression vector, and guide RNA expression vector were transfected using Lipofectamine® 3000 reagent (Thermo Fisher Scientific) following manufacturer's instructions. For electroporation, cells are electroporated using the Neon® Transfection System (Thermo Fisher Scientific) following manufacturer's instructions.

24-48 hours after lipofection or electroporation, the expression of GFP was determined by microscopically surveying the cells for the presence of GFP+ cells. Following visual inspection, the proportion of GFP+ cells versus GFP− cells may be determined. Fluorescence was observed for mammalian cells expressing deaminase-RGN fusion proteins reported in Table 21. A person of skill in the art will appreciate that the cells may also be lysed using RIPA buffer, and the resulting lysate may be analyzed on a fluorescence plate reader to determine the fluorescence intensity for BFP and GFP. Additionally, the cells may be analyzed by cell sorting to determine the exact proportions of BFP+, GFP+, and GFP− cells.

TABLE 21

| Mammalian Cytosine Deaminase Fluorescence Reporter Results | |
|---|---|
| Deaminase ID | Relative GFP+ Cells |
| APG09260 | N.D. |
| APG09980 | + |
| APG07386-CTD | ++ |
| APG05840 | + |
| APG00868 | ++ |

N.D = None Detected; + = few GFP+ cells detected, ++ = many GFP+ cells detected

Example 15: Diversification of Deaminases for Creation of Adenosine and Cytosine Base Editors Adenosine base editors (ABEs), which are capable of changing an A or T residue in a DNA sequence to a G or a C, are not known to naturally occur. The following diversification strategies were used to generate deaminase variants for the goal of identifying an ABE which acts on a DNA template.

The first strategy was random mutagenesis by error prone PCR enzymes, similar to Gaudelli et al (*Nature*, 2017, doi:10.1038/nature24644, incorporated by reference herein). Primers were designed and nucleotide sequences to the 125 ADAT enzymes of Table 17 were produced. Error prone PCR was carried out following manufacturer's instructions using the GenMorph II Random Mutagenesis Kit (Agilent Technologies). Mutated ADAT PCR products were purified following manufacturer's instructions using the ZR-96 DNA Clean-up Kit™ (Zymo Research). From this approach, about 10 million ADAT variants were produced.

A second strategy pursued was gene shuffling, similar to Stemmer, W. P. C. (*Proc. Natl. Acad. Sci. USA,* 1994).

Coding sequences for the 125 ADAT enzymes of Table 17 were PCR-amplified essentially following manufacturer's instructions using Phusion® High-Fidelity DNA Polymerase (NEBiolabs) and purified using the DNA Clean & Concentrator™-5 (Zymo Research) following manufacturer's instructions. The purified DNA of the different ADAT coding sequences was pooled and subjected to restriction digestion by the enzymes RsaI, AfeI, BsaAI, and BsaHI in Cutsmart® buffer at 37° C. for 60 minutes. Following digestion, the reactions were separated by gel electrophoresis and digested fragments were purified using the Zymoclean™ Gel DNA Recovery Kit. The purified fragments were then assembled using PCR amplification, and the assembled amplified products were purified. From this approach, about 2 million ADAT variants were produced.

The final strategy was to target residues homologous to structural residues that potentially interact with nucleic acids. For ADAT-like enzymes, careful examination of the crystal structure of *Staphylococcus aureus* tRNA Adenosine Deaminase, TadA, in complex with RNA (RCSB Protein Data Bank ID No: 2B3J; Losey et al., 2006, *Nat. Struct. Mol. Biol.* 13: 153-159) revealed potential interactions at residues homologous to *E. coli* TadA (UniProt P68398 and GenBank Acc. No. NP_417054) P48, L84, A106, D108, and K110. Saturation mutagenesis of these homologous residues was then undertaken for 125 ADAT-domain deaminases from Table 17. From this approach, about one million ADAT variants were produced.

A person of skill in the art will appreciate that these approaches are not exclusive and can be combined and applied to the output of each successive round of improvement. Saturation mutagenesis or iterative saturation mutagenesis (Reetz and Carballeira, 2007, *Nature Protocols*, 2 (4): 891-903) are known to be iterative, meaning that the best performing candidates from one round are selected for further rounds of mutation and screening until an optimal candidate is identified.

Example 16: Determination of Active Diversified Deaminases for the Creation of Adenosine Base Editors and Cytosine Base Editors Example 16.1: Bacterial Activity Assays for Diversified Deaminases The ADAT mutant variant products from the diversified rounds of Example 15 above were introduced into an expression cassette which produces a fusion protein comprising an NLS at its N-terminal end (SEQ ID NO: 10) operably linked at its C-terminal end to a mutated deaminase, operably linked at its C-terminal end to a linker sequence (SEQ ID NO: 546), operably linked at its C-terminal end to a RNA-guided, DNA binding protein, namely a nuclease-inactive RNA-guided nuclease (RGN) dAPG08290.1 variant (SEQ ID NO: 547), operably linked at its C-terminal end to a second NLS, operably linked at its C-terminal end to a TEV site (SEQ ID NO: 548), operably linked at its C-terminal end to a 10× His tag (SEQ ID NO: 594).

This activity assay was very similar to Example 13. However, for these experiments constructs were made that had a deactivated Chloramphenicol gene that had H193 mutated to either H193R (SEQ ID NO: 566) for Cytosine Base Editing Selection, or H193Y (SEQ ID NO: 567) for Adenosine Base Editing Selection. Each plasmid also contained a guide RNA to target the RGN-deaminase fusion to the appropriate region of the plasmid. Upon successful CG to TA conversion (for SEQ ID NO: 566) or AT to GC conversion (for SEQ ID NO: 567), the bacterial cells would be capable of surviving in a media containing chloramphenicol.

The fusion protein expression vectors, along with vectors comprising the deactivated Chloramphenicol gene and targeting sgRNA, were introduced into T7 Express *E. coli* cells (NEBioLabs). The cells were grown to saturation and then used as a source for inoculum of a self-inducing media (MagicMedia™, Thermo Fisher Scientific), and then grown for an additional 5 hours. Cells were dilution-plated on LB with kanamycin and carbenicillin; these dilution-plates were used to get a total cell count. The same cells were also plated on LB with kanamycin, carbenicillin, and chloramphenicol to identify colonies which carried active mutated deaminases. Representative clones were picked and sequenced and then tested individually. Additionally, the same cells were also plated on LB with kanamycin and rifampicin to measure "untargeted" mutation rates. Mutation rates ("Mutn Rate") for the targeted deaminase-RGN fusion proteins to the H193R plasmid ("CBE") were calculated and the mutation rates for the targeted deaminase-RGN fusion proteins to the H193Y plasmid ("ABE") and are shown in Table 22. The relative rates for adenine base editing ("ABE Rel Rate"), cytosine base editing ("CBE Rel Rate"), and off-targeting ("Off-T Rel Rate) compared to the background observed in cells containing only the dead RGN (dAPG08290.1; SEQ ID NO: 547) are also indicated. Positive control mammalian deaminases known to function as a cytosine deaminase were also included.

TABLE 22

| | | | | | | | |
|---|---|---|---|---|---|---|---|
| Mutation rates of selected mutated deaminases | | | | | | | |
| Deaminase ID | SEQ ID NO. | ABE Mutn Rate | CBE Mutn Rate | Off Target | ABE Rel Rate | CBE Rel Rate | Off-T Rel Rate |
| APG05241 | 397 | 4.44E−09 | 5.25E−05 | 3.64E−06 | 14 | 1110 | 170 |
| APG08360 | 411 | 0.00E+00 | 8.72E−07 | 1.40E−08 | 0 | 18 | 1 |
| APG09980 | 420 | 4.57E−09 | 6.35E−06 | 1.10E−05 | 14 | 134 | 514 |
| APG00868 | 374 | 6.57E−10 | 2.27E−04 | 5.02E−07 | 2 | 4796 | 23 |
| APOBEC3A (positive control) | 571 | 0.00E+00 | 6.06E−04 | 8.45E−06 | 0 | 12809 | 395 |
| APG07164 T102K D104Y K106T | 572 | 6.46E−08 | 5.76E−05 | 1.16E−08 | 204 | 1218 | 1 |
| NTerm_APG03542(1-88)& Cterm_APG02410(114-179) | 573 | 9.93E−08 | 3.56E−05 | 1.69E−08 | 313 | 1 | 1 |
| APG07458 | 514 | 5.13E−07 | 2.31E−08 | 2.60E−08 | 1621 | 0 | 1 |
| APG06334_A101E_D103S_A105K | 574 | 3.56E−08 | 8.13E−08 | ND | 112 | 2 | ND |
| APG03856_A101K_D103L_K105E | 575 | 1.62E−08 | 7.30E−09 | ND | 51 | 0 | ND |
| APG08799 D105A_K107R | 576 | 5.74E−07 | 3.16E−06 | 2.60E−08 | 1812 | 67 | 1 |

TABLE 22-continued

Mutation rates of selected mutated deaminases

| Deaminase ID | SEQ ID NO. | ABE Mutn Rate | CBE Mutn Rate | Off Target | ABE Rel Rate | CBE Rel Rate | Off-T Rel Rate |
|---|---|---|---|---|---|---|---|
| APG02312_A102G_D104S_K106R | 577 | 1.10E–07 | 4.46E–07 | 2.56E–08 | 347 | 9 | 1 |
| APG09352_D105S_K107T | 578 | 1.36E–06 | 9.34E–08 | 4.34E–08 | 4293 | 2 | 2 |
| APG02312_A102S_D104Q_K106G | 579 | 1.36E–06 | 9.34E–08 | 4.34E–08 | 4293 | 2 | 2 |
| APG03140_D111G | 580 | 1.24E–06 | 4.48E–08 | 4.63E–08 | 3921 | 1 | 2 |
| APG03557_A104Q_D106G_K108R | 581 | 1.12E–06 | 6.90E–07 | 3.80E–08 | 3522 | 15 | 2 |
| APG07164_T102R D104W K106E | 582 | 3.83E–08 | 1.81E–07 | 2.24E–08 | 121 | 4 | 1 |
| APG02312_D104R_K106S | 583 | 2.11E–06 | 6.53E–08 | 1.64E–08 | 6663 | 1 | 1 |
| APG03140_A110F_D112S_K114T | 584 | 4.16E–07 | 3.50E–08 | 4.61E–08 | 1314 | 1 | 2 |
| dAPG08290.1 | 547 | 3.17E–10 | 4.73E–08 | 2.14E–08 | 1 | 1 | 1 |

Example 16.2: Fluorescence Assay for Targeted Base Editing

A vector harboring Enhanced Green Fluorescent Protein (EGFP) containing a W58* mutation which causes a premature STOP codon (SEQ ID NO: 564) was constructed such that the W58 codon can be reverted from STOP (TGA) to the wildtype tryptophan (TGG) residue using an adenosine deaminase to alter the third position A to G. Successful A to G conversion results in the expression of EGFP which can be quantified. A second vector capable of expressing a guide RNA which targets the deaminase-RGN fusion protein to the region around the W58* mutation (SEQ ID NO: 565) was also produced.

This dead EGFP to EGFP reporter vector, along with the vectors capable of expressing the deaminase-RGN fusion protein and the guide RNA, were transfected into HEK293T cells, using either lipofection or electroporation. For lipofection, cells were seeded at 1×10^5 cells/well in 24-well plates the day prior to transfection in growth medium (DMEM+10% Fetal Bovine Serum+1% Penicillin/streptomycin). 500 ng each of the dead EGFP reporter vector, deaminase-RGN expression vector, and guide RNA expression vector were transfected using Lipofectamine® 3000 reagent (Thermo Fisher Scientific) following manufacturer's instructions. For electroporation, cells are electroporated using the Neon® Transfection System (Thermo Fisher Scientific) following manufacturer's instructions.

24-48 hours after lipofection or electroporation, the expression of GFP was determined by microscopically surveying the cells for the presence of GFP+ cells. Following visual inspection, the proportion of GFP+ cells versus GFP– cells may be determined. Fluorescence was observed for mammalian cells expressing deaminase-RGN fusion proteins reported in Table 23. A person of skill in the art will appreciate that the cells may also be lysed using RIPA buffer, and the resulting lysate may be analyzed on a fluorescence plate reader to determine the fluorescence intensity for GFP. Additionally, the cells may be analyzed by cell sorting to determine the exact proportions of GFP+, and GFP– cells.

TABLE 23

Mammalian Adenosine Deaminase Fluorescence Reporter Results

| Deaminase ID | SEQ ID NO. | Relative GFP+ Cells |
|---|---|---|
| APG07164 T102K D104Y K106T | 572 | + |
| NTerm_APG03542(1-88)&Cterm_APG02410(114-179) | 573 | + |
| APG06334_A101E_D103S_A105K | 574 | ++ |
| APG03856_A101K_D103L_K105E | 575 | + |
| APG08799 D105A_K107R | 576 | ++ |
| APG09352_D105S_K107T | 578 | + |
| APG02312_A102S_D104Q_K106G | 579 | + |
| APG03140_D111G | 580 | + |
| APG03557_A104Q_D106G_K108R | 581 | +++ |
| APG02312_D104R_K106S | 583 | + |
| APG03140_A110F_D112S_K114T | 584 | + |

+ = few GFP+ cells detected, ++ = many GFP+ cells detected, +++ = highest number of GFP+ cells observed

SEQUENCE LISTING (617 sequences)

SEQ ID NO: 1 - protein, 1060 aa, Bacillus sp.
  source: /note="APG00969"
MKQTSYSLGLDIGIASVGYGLIDNDENIVDAGVRLFPEANSKNNDGRRKSRGSKRLIRRKRHRIARVKHLLKESGIDVSYENTVLTNPYEIRCKGLTLPLTNHELSIALLHLAKRRGVHNVKSMDQEKVKGNELSTKEQLTINDNLLEEKFICELQLERLNKEGIVRSHSNRFKTADYIKEIKNLLETQAKQNTLVTEEFIEKYIEIFSGRRKYYEGPGGESKYGWKGDIEKWYEGLMGKCTYFPKELRCVKHAYSAALFNLLNDLNNLSINREEDTKLSQYEKEQIIEKIFKVRKTPTLTQIAKLLKVDPTNIKGFRTKANGTPDFLSIKIYHDLKGIIDDKQLLDDIAFLDNVAQILTVWQDSQSIQEKLKTLNKNLDDKTIKEISELKKYTQTHSLSLKLINVLLPELWETTKNQMTILSELKLKPRKIDLHNCNEIPVNMINDLIVSPVVRRSLTQSIEMINQIIKDYGHPREIVIELAREKNSEEKKNFIKSLNEKNKQINDEVIEKLNASNHRDNKGMFNKVKLWILQDGHCLYSLKPIRLEDLLNNPNHYEIDHIIPKSVSFDDSMSNKVLVYQIENSKKGNRTPYQYLTSADKTITYEKFKANITQLAKSNHKISKKKLDYLLEERDINRFHIKKEFINRNLVDTRYATRSLINLLKYYFSEKDINVKVKSINGSFTDYLRKLWNFPKDREFYHKHHAEDALIIAMANKIFTTRKIFKEQNSVFSDEQILDGEVTNILSDDQFQAEFTEKFYKVQAIKKYDKYKYSHRVDKKPNRQLFDDTLYSTREFEGEEYYIGKIKDIYNLKDKRLKKIFTKSPEKILMYQHDSQTFKKLKQIMRSYEDEVNPLAKYHKETGEYLRKECKKGNGPIVKSLKYRVTKLGVHKDITHKYENSKNKVVILSLKPFRMDVFKENGVYKFITIRYCDLKETVNSYTISEHLYKAKLKAKDIKSMDSFKWSFYKNDLLEYNGELCTFKGVNDDKKNKIEVNWVEKNFAIYAEKKNLKSKQLVKSITKSTVKSLLKYTTDILGNRYPVRNEKLKLMIRKQTFRGDL

SEQ ID NO: 2 - RNA, 16 nt, Bacillus sp.
  source: /note="crRNA"
guuuuaguacucugug

SEQ ID NO: 3 - RNA, 73 nt, Bacillus sp.
  source: /note="tracrRNA"
cacagaaucuacuaaaauaaggcauaaugccguauuuaaucccaucauaauucugaugggauuuuuuauauuu

SEQ ID NO: 4 - RNA, 118 nt, Artificial Sequence
  source: /note="Description of Artificial Sequence: Synthetic polynucleotide"
  modified_base (1)..(25): a, c, u, g, unknown or other
nnnnnnnnnnnnnnnnnnnnnnnnnguuuuaguacucugugaaagcacagaaucuacuaaaauaaggcauaaugccguauuuaaucccaucauaauucugaugggauuuuuuauauuu

SEQ ID NO: 5 - RNA, 123 nt, Artificial Sequence
  source: /note="Description of Artificial Sequence: Synthetic polynucleotide"
gagcggacagcagcuuccuauaucucguacguuuuaguacucugugaaagcacagaaucuacuaaaauaaggcauaaugccguauuuaaucccaucauaauucugaugggauuuuuuauauuu

SEQ ID NO: 6 - RNA, 123 nt, Artificial Sequence
  source: /note="Description of Artificial Sequence: Synthetic polynucleotide"
ccaugauauagacguuguggcuguuguaguguuuuaguacucugugaaagcacagaaucuacuaaaauaaggcauaaugccguauuuaaucccaucauaauucugaugggauuuuuuauauuu

SEQ ID NO: 7 - DNA, 5 bp, Artificial Sequence
  source: /note="Description of Artificial Sequence: Synthetic oligonucleotide"
  modified_base (1)..(2): a, c, t, g, unknown or other
nnarv

SEQ ID NO: 8 - DNA, 4 bp, Artificial Sequence
  source: /note="Description of Artificial Sequence: Synthetic oligonucleotide"
aaag

SEQ ID NO: 9 - DNA, 13 bp, Artificial Sequence
  source: /note="Description of Artificial Sequence: Synthetic oligonucleotide"
gccgccrccatgg

SEQ ID NO: 10 - protein, 7 aa, Artificial Sequence
  source: /note="Description of Artificial Sequence: Synthetic peptide"
PKKKRKV

SEQ ID NO: 11 - protein, 22 aa, Artificial Sequence
  source: /note="Description of Artificial Sequence: Synthetic peptide"
DYKDHDGDYKDHDIDYKDDDDK

SEQ ID NO: 12 - protein, 16 aa, Artificial Sequence
  source: /note="Description of Artificial Sequence: Synthetic peptide"
KRPAATKKAGQAKKKK

SEQ ID NO: 13 - RNA, 6 nt, Artificial Sequence
  source: /note="Description of Artificial Sequence: Synthetic oligonucleotide"
  modified_base (2)..(2): a, c, u, g, unknown or other
  modified_base (4)..(5): a, c, u, g, unknown or other
unannc

SEQ ID NO: 14 - DNA, 38 bp, Artificial Sequence
  source: /note="Description of Artificial Sequence: Synthetic oligonucleotide"
  modified_base (31)..(38): a, c, t, g, unknown or other
gagcggacagcagcttcctatatctcgtacnnnnnnnn

SEQ ID NO: 15 - DNA, 38 bp, Artificial Sequence
  source: /note="Description of Artificial Sequence: Synthetic oligonucleotide"
  modified_base (31)..(38): a, c, t, g, unknown or other
ccatgatatagacgttgtggctgttgtagtnnnnnnnn

SEQ ID NO: 16 - protein, 1090 aa, Rhizobium sp.
  source: /note="APG03128"
MNNLLYSFDIGTNSIGWCVFALDEVGDPCRIVDLGARIYADGRDPQTKTSLAVARREARAMSRRRDRSLRRRKATLRTMIEYGLMPAHKVEQETLLRKTGDREGGDEGFNPYALRARALGEKLPPFYIGRALFHLGQRRGFKSNRKTDRKDNDKGKIALGIDELRAAMHRSGSPTLGAWLAMRRADGHPVRLRAGSEVFDAEGYAFYPERSLLEDEFRQIWTAQAVHHPQLLTSERRAHLFRVMFYQRPLKKPLVGRCSFNPAEARLSRAHPLFQEFRLYKEVNDLEVVLPDQSHRKLTLDERNALVAKLKSSRKASFSVLRRTLKLTPDLAFNKESEARKDLLGDEINSALADAKMFGVRWGGFPRARQWEIITHLKEEENPARLSDWLKSEFGLDDERVVAIANIALPEGYGRLGETALASMLEEMKTAVIPESEAAKRCGYDHSNLAKEQDEGLDILPEYQEILERHIPPGTGDPDDIYDIRKGRITNPTVHIGLNQLRRVVNALIKRHGKPRHIVVELARDLQLSEKQKADVNRRIAKNTREAEGRSQKLIEMGQLDTGYNRLLLKLWEELNQDKPEDRVCIYSGKPIGIAMLFSGEVDIDHILPWSKTLDDSQANKLLCLKSANRQKRNRTPSDVPEWRDCYEEVLARAARLPKNKRWRFAADAMQQFEAEGGFLARQLTDTQYLSRMAFEYLSALFPSEEADKWGELRQRKRVHVVPGRLTELLRRNWGLNTLLPDHNLGEMAQEKNRKDHRHHAIDAAVIGVTSRSLLQRMSGAAARLDDVAFDDLVRTVVKDNPPWPGFREELLGCINRVTVSHKPDHGTVSRAAYAQGKGQTAGKLHNDTAYGITGLQDMKGSPLVVRRKPFMALEVKDIASIRDTELQSALYDAIGSLTEKKALQEALVRFRDRHPQFKGIRRVRVLEALSVIPIVDNNGKAYKGYKGDANYRYEVWETLDGRWHTEVVSMFDAHQPGWQSPFHRQHPAARRVLKLQQNDMVAYEHPADGYTIARVVKFSNDKRIYFASHRESGSLKARDADKGDPFTYFAKANNGLRDIKCRQVRIDAAGRVFDPGPQDREARQSKGRA

SEQ ID NO: 17 - RNA, 31 nt, Rhizobium sp.
  source: /note="crRNA"
gguugcggcuggaccgcguuuucugaucugc

SEQ ID NO: 18 - RNA, 79 nt, Rhizobium sp.
  source: /note="tracrRNA"
gcaaaucagaaaacgcggucuggccguuaacaagccucgaccagcaccagauaaggcggucccuccgggggccguuuuu

SEQ ID NO: 19 - RNA, 139 nt, Artificial Sequence
  source: /note="Description of Artificial Sequence: Synthetic polynucleotide"
  modified_base (1)..(25): a, c, u, g, unknown or other
nnnnnnnnnnnnnnnnnnnnnnnnngguugcggcuggaccgcguuuucugaucugcaaaggcaaaucagaaaacgcggucuggccguuaacaagccucgaccagcaccagauaaggcggucccuccgggggccguuuuu

SEQ ID NO: 20 - RNA, 144 nt, Artificial Sequence
  source: /note="Description of Artificial Sequence: Synthetic polynucleotide"
gagcggacagcagcuuccuauaucucguacgguugcggcuggaccgcguuuucugaucugcaaaggcaaaucagaaaacgcggucuggccguuaacaagccucgaccagcaccagauaaggcggucccuccgggggccguuuuu

SEQ ID NO: 21 - RNA, 144 nt, Artificial Sequence
  source: /note="Description of Artificial Sequence: Synthetic polynucleotide"
ccaugauauagacguuguggcuguuguagugguugcggcuggaccgcguuuucugaucugcaaaggcaaaucagaaaacgcggucuggccguuaacaagccucgaccagcaccagauaaggcggucccuccgggggccguuuuu

SEQ ID NO: 22 - DNA, 7 bp, Artificial Sequence
  source: /note="Description of Artificial Sequence: Synthetic oligonucleotide"
  modified_base (1)..(2): a, c, t, g, unknown or other
  modified_base (5)..(6): a, c, t, g, unknown or other
nnggnnc

SEQ ID NO: 23 - RNA, 6 nt, Artificial Sequence
  source: /note="Description of Artificial Sequence: Synthetic oligonucleotide"
  modified_base (2)..(2): a, c, u, g, unknown or other
  modified_base (4)..(5): a, c, u, g, unknown or other
angnnu

SEQ ID NO: 24 - protein, 1108 aa, Brevibacillus sp.
  source: /note="APG09748"
MAIRSIKLKLKTRTGPEAQNLRKGIWRTHRLLNEGVAYYMKMLLLFRQESTGGQTKKELQEELVRHIREQQQKNRADKNTQALPLDKAFAALRQLYELLVPSSIGQSGDAQIISRKFLSPLVDPNSEGGKGTSKAGAKPTWQKKKEANDPTWEQDYEKWKKRREEDPTASVITTLEEYGIRPIFPLYTNTVADIAWLPLQSNQFVRTWDRDMLQQAIERLLSWESWNKRVQEEYSKLQEKMTQLNEQLEGGQEWISLLEQYEEQREQELIENMTAANDKYRITKRQMKGWNELYEQWSTVLPNASHEQYREALKRVQQRLRGRFGDAHFFQYLMKEEHHLIWKGNPQRIHYFVARNELKKRLEEAKQNATMTLPDARKHPLWVRFDARGGNLQDYYLTAEADNPRSRRFVTFSQLIWPNESGWMEKQDVEVELALSKQFYQQVTLQKNDKGKQEIEFKDKGSGSTFSGHLGGAKLQLERGDLEKEEKDFEGGEIGSVYLNIVIDFEPLQEVKNGRLQSPYGQVLQLVRRPNEFPKVTTYKSEELVEWIKSSTKDSAGVESLESGFRVMSIDLGLRTAAATSIFSVEESNDANAAGFSYWIEGTPLVAVHKRSYMLKLPGEQVEKQVREKRDERQDQQRRVRFQIRILSQVIRMAKKQNRERADELDHLSQALEKQKSLLDQTDRTFWNGIVCDLTDALREKEGGWEQAVVQIHRKAEEHVGKVVQAWRKRFDADERKGIAGLSMWSIEELDSLRKLLISWSRRTRNPREINCFEQGHTSHQRLLTHIQNVKEDRLKQLSHAIVMTALGYVYDEKKLEWFAKYPACQVILFENLSQYRSNMDRSTKENSTLMKWAHRSIPKYVHMQAEPYGIQIGDVRAEYSSRFHAKTGTPGIRCKMVSGHDLQGRRFENLQKRLISEQFLTEEQVKQLRPGDIVPDDSGEWFMTLSDGSEGKEVVFLQADINAAQNLQKRFWQRYNELFKVSCRVLIRGEEEYLIPKTKSVQAKLGKGLFVKKTDTVMKDVYVWDSQAKLKGKTTFTEESESPEQLEDFQEIIEEAEEAKGTYRTLFRDPSGVFFPEFVWSTQKDFWSEVKRRLYGKLRERFLMKTR

SEQ ID NO: 25 - RNA, 22 nt, Brevibacillus sp.
  source: /note="crRNA"
uggaaagcuucgagguuagcac

SEQ ID NO: 26 - RNA, 95 nt, Brevibacillus sp.
  source: /note="tracrRNA"
cgacgguuagaggccguaugucgauuugcuuuaauuucgugcgugugcauugucguccuccauuacagggcggcuaccacgaauagccacgaagu

SEQ ID NO: 27 - RNA, 151 nt, Artificial Sequence
  source: /note="Description of Artificial Sequence: Synthetic polynucleotide"
  modified_base (132)..(151): a, c, u, g, unknown or other
cgacgguuagaggccguaugucgauuugcuuuaauuucgugcgugugcauugucguccuccauuacagggcggcuaccacgaauagucacgaaguuccacugaguaaaguggaaagcuucgagguuagcacnnnnnnnnnnnnnnnnnnnn

SEQ ID NO: 28 - RNA, 145 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguaaaagcuucguggcuagcacguacgagauauaggaagcugcuguccgcuc

SEQ ID NO: 29 - RNA, 145 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguaaaagcuucguggcuagcacacuacaacagccacaacgucuauaucaugg

SEQ ID NO: 30 - DNA, 4 bp, Artificial Sequence
  source: /note="Description of Artificial Sequence: Synthetic oligonucleotide"
  modified_base (4)..(4): a, c, t, g, unknown or other
dttn

SEQ ID NO: 31 - DNA, 4 bp, Artificial Sequence
  source: /note="Description of Artificial Sequence: Synthetic oligonucleotide"
aaaa

SEQ ID NO: 32 - DNA, 38 bp, Artificial Sequence
  source: /note="Description of Artificial Sequence: Synthetic oligonucleotide"
  modified_base (1)..(8): a, c, t, g, unknown or other
nnnnnnnngtacgagatataggaagctgctgtccgctc

SEQ ID NO: 33 - DNA, 37 bp, Artificial Sequence
  source: /note="Description of Artificial Sequence: Synthetic oligonucleotide"
  modified_base (1)..(8): a, c, t, g, unknown or other
nnnnnnnnactacaacagccacaacgtctatatcatg

SEQ ID NO: 34 - DNA, 4 bp, Artificial Sequence
  source: /note="Description of Artificial Sequence: Synthetic oligonucleotide"
  modified_base (4)..(4): a, c, t, g, unknown or other
dttn

SEQ ID NO: 35 - protein, 1429 aa, Chryseobacterium sp.
  source: /note="APG00771"
MTKNILGLDLGTNSIGWALIKQDFENKQGEILGMGSRIIPMDAGDMGKFAEGATVSKTADRTKYRSVRRLRERFLLRRERLHRVLHLLNFLPQHYASQIDFEKRFGKFKVETEPKLAWKNIEGKFSFLFQNSFNEMLEDFKANEQDLKIPYDWTIYFLRKKALSQKIEKEELAWILLNFNQKRGYYQLRGEEEEENPNKLVEFYSLKVVDVLADEPQKGKSEIWYSLVLKNGWIYRRASKIPLFEWKDKTRDFIVTTDLNDDGSIKKDKDGNEKRSFRAPGENDWTLVKKKTEQEIEQSHKTVGTYIYETLLLNPKQKIKGKLVRTIERKFYKDELKQILEKQKEFHQELQNDDLYNDCIRELYRNNEAHQLTLSKKDFVHLLMDDLIFYQRPLRSQKSSISNCTLEFRKYKDENGIEHTQYLKAIPKSNPYYQEFRLWQWIYNLNIYRKDDEVNVTKDFLNTTKEFENLFEFLNSRKEVDQKALLKYFKLNEKTHRWNFVEDKKYPCNETKTMISSRLDKVENISDDFLTRNIEQKIWHIIYSVNDKIEYEKALKSFARKHHLDETSFFEAFRKFPPFKSEYGSFSEKAIKKLLPLMRLGKYWNYADIDKYSRERIQKIITGEYDENIKDKIREKAIHLTKENDFQGLQLWLAQYLVYGRHSEASMIGKWNSADDLEVFLKDFKQHSLRNPIVEQVITETLRVVKDIWLKYGNGTKDFFNEIHIELGREMKLPADDRKKLTSQISENENTNLRIKALLAEMINDHSVENVRPFSPMQQEILKIYEDGVLNSDIEIEDDILKISKTAQPSPSDLKRYKLWLEQKYKSPYTGQIIPLNKLFTPEYEIEHIIPQSRYFDDSFSNKVICESAVNKLKDNYIGLEFIKKLGGTVVECGNGKSVTVLKEDQYEDFVKKHYANNRGKRNKLLMEDIPEKMIERQLNDTRYISKYISGVLSNIVRVEDGSDEGINSKNIVPGNGKITSQLKQDWGLNDVWNDLILPRFERMNQLTNSTDFTAWNENYQKFLPTVPIEYSKGFSKKRIDHRHHALDALVIACATKDHVNLLNNQSAKSDTKRYDLKKKLMKFEKVVYHHTQTGEKIEREIPRQFLKPWENFTVDAKHNLESIIVSFKQNLRVINKATNYYEKYVEKDGTKNKERVEQTGTNWAIRKPMHKDTVSGKVDLPWVKVPKGKILTATRKSLDTSFDLKSIGSITDTGIQKILKNYLAFKDGNPEMAFSPEGIDDLNKNIEKYNDGKPHQPINKVRVFELGSKFQVGQTGNKKDKYVEAAKGTNLFFAVYEDEKGKRSYETIPLNEVIERQKQGLSVVDLKDTNDFYLCPNDLVYIPSGDELENVNNVDFKDIKKDKNERIYKVVSFSGSQIFFVRQDIATFIVNKAELSTLNKMERAIDGSMIKENCIKLNIDRLGNISKA

SEQ ID NO: 36 - RNA, 20 nt, Chryseobacterium sp.
  source: /note="crRNA"
guugugaauugcuuucaaaa

SEQ ID NO: 37 - RNA, 76 nt, Chryseobacterium sp.
  source: /note="tracrRNA"
uuuugaaagcaauucacaauaaggauuauuccguugugaaaacauucaaggcggggcaacucgccuuuuuucguuu

SEQ ID NO: 38 - RNA, 125 nt, Artificial Sequence
  source: /note="Description of Artificial Sequence: Synthetic polynucleotide"
  modified_base (1)..(25): a, c, u, g, unknown or other
nnnnnnnnnnnnnnnnnnnnnnnnnguugugaauugcuuucaaaaaaaguuuugaaagcaauucacaauaaggauuauuccguugugaaaacauucaaggcggggcaacucgccuuuuuucguuu

SEQ ID NO: 39 - RNA, 130 nt, Artificial Sequence
  source: /note="Description of Artificial Sequence: Synthetic polynucleotide"
gagcggacagcagcuuccuauaucucguacguugugaauugcuuucaaaaaaaguuuugaaagcaauucacaauaaggauuauuccguugugaaaacauucaaggcggggcaacucgccuuuuuucguuu

SEQ ID NO: 40 - RNA, 130 nt, Artificial Sequence
  source: /note="Description of Artificial Sequence: Synthetic polynucleotide"
ccaugauauagacguuguggcuguuguaguguugugaauugcuuucaaaaaaaguuuugaaagcaauucacaauaaggauuauuccguugugaaaacauucaaggcggggcaacucgccuuuuuucguuu

SEQ ID NO: 41 - DNA, 6 bp, Artificial Sequence
  source: /note="Description of Artificial Sequence: Synthetic oligonucleotide"
  modified_base (1)..(2): a, c, t, g, unknown or other
nnraat

SEQ ID NO: 42 - RNA, 6 nt, Artificial Sequence
  source: /note="Description of Artificial Sequence: Synthetic oligonucleotide"
  modified_base (2)..(2): a, c, u, g, unknown or other
  modified_base (4)..(5): a, c, u, g, unknown or other
unanna

SEQ ID NO: 43 - protein, 1112 aa, Bacillus sp.
  source: /note="APG02789"
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 44 - RNA, 36 nt, Bacillus sp.
  source: /note="crRNA"
gccugaauacuuagcagaaauaaugaugauuggcac

SEQ ID NO: 45 - RNA, 100 nt, Bacillus sp.
  source: /note="tracrRNA"
auaauaaaggugaccuauagggucaaugaaucugugcgugugccauaaguaauuaaaaauuacccaccacaggauuaucuuauuucugcuaaguguuuag

SEQ ID NO: 46 - RNA, 160 nt, Artificial Sequence
  source: /note="Description of Artificial Sequence: Synthetic polynucleotide"
  modified_base (141)..(160): a, c, u, g, unknown or other
auaauaaaggugaccuauagggucaaugaaucugugcgugugccauaaguaauuaaaaauuacccaccacaggauuaucuuauuucugcuaaguguuuagaaaggccugaauacuuagcagaaauaaugaugauuggcacnnnnnnnnnnnnnnnnnnnn

SEQ ID NO: 47 - RNA, 170 nt, Artificial Sequence
  source: /note="Description of Artificial Sequence: Synthetic polynucleotide"
auaauaaaggugaccuauagggucaaugaaucugugcgugugccauaaguaauuaaaaauuacccaccacaggauuaucuuauuucugcuaaguguuuagaaaggccugaauacuuagcagaaauaaugaugauuggcacguacgagauauaggaagcugcuguccgcuc

SEQ ID NO: 48 - RNA, 170 nt, Artificial Sequence
  source: /note="Description of Artificial Sequence: Synthetic polynucleotide"
auaauaaaggugaccuauagggucaaugaaucugugcgugugccauaaguaauuaaaaauuacccaccacaggauuaucuuauuucugcuaaguguuuagaaaggccugaauacuuagcagaaauaaugaugauuggcacacuacaacagccacaacgucuauaucaugg

SEQ ID NO: 49 - DNA, 4 bp, Artificial Sequence
  source: /note="Description of Artificial Sequence: Synthetic oligonucleotide"
  modified_base (4)..(4): a, c, t, g, unknown or other
attn

SEQ ID NO: 50 - protein, 1108 aa, Brevibacillus sp.
  source: /note="APG09106"
MAIRSIKLKLKTRTGPEAQNLRKGIWRTHRLLNEGVAYYMKMLLLFRQESTGGQTKKELQEELVRHIREQQQKNRADKNTQALPLDKAFAALRQLYELLVPSSIGQSGDAQIISRKFLSPLVDPNSEGGKGTSKAGAKPTWQKKKEANDPTWEQDYEKWKKRREEDPTASVITTLEEYGIRPIFPLYTNTVADIAWLPLQSNQFVRTWDRDMLQQAIERLLSWESWNKRVQEEYSKLQEKMTQLNEQLEGGQEWISLLEQYEEQREQELIENMTAANDKYRITKRQMKGWNELYEQWSTVLPNASHEQYREALKRVQQRLRGRFGDAHFFQYLMKEEHHLIWKGNPQRIHYFVARNELKKRLEEAKQNATMTLPDARKHPLWVRFDARGGNLQDYYLTAEADNPRSRRFVTFSQLIWPNESGWMEKQDVEVELALSKQFYQQVTLQKNDKGKQEIEFKDKGSGSTFSGHLGGAKLQLERGDLEKEEKDFEGGEIGSVYLNIVIDFEPLQEVKNGRLQSPYGQVLQLVRRPNEFPKVTTYKSEELVEWMKASQNHSSGVESLESGFRVMSIDLGLRTAAATSIFSVEESNDANAAGFSYWIEGTPLVAVHKRSYMLKLPGEQVEKQVREKRDERQDQQRRVRFQIRILSQVIRMAKKQNRERADELDHLSQALEKQKSLLDQTDRTFWNGIVCDLTDALREKEGGWEQAVVQIHRKAEEHVGKVVQAWRKRFDADERKGIAGLSMWSIEELDSLRKLLISWSRRTRNPQEINRFEQGHTSHQRLLTHIQNVKEDRLKQLSHAIVMTALGYVYDEKKLEWFAKYPACQVILFENLSQYRSHMDRSTKENSTLMKWAHRSIPKYVHMQAEPYGIQIGDVRAEYSSRFHAKTGTPGIRCKMVKGQELQGKRFENLQKRLVSEQFLTEEQVKQLRPGDIVPDDSGEWFMTLSDGSEGKEVVFLQADINAAQNLQKRFWQRYNELFKVSCRVLIRGEEEYLIPKAKSVQAKLGKGLFVKKTDTVMKDVYVWDSQAKLKGKTTFTEESESPEQLEDFQEIIEEAEEAKGTYRTLFRDPSGVFFPEFVWNTQKDFWSEVKRRLYGKLRERFLMKTR

SEQ ID NO: 51 - RNA, 22 nt, Brevibacillus sp.
  source: /note="crRNA"
uggaaagcuucgagguuagcac

SEQ ID NO: 52 - RNA, 105 nt, Brevibacillus sp.
  source: /note="tracrRNA"
cgacgguuagaggccguaugucgauuugcuuuaauuucgugcgugugcauugucguccuccauuacagggcggcuaccacgaauagucacgaaguuccacugagu

SEQ ID NO: 53 - RNA, 151 nt, Artificial Sequence; identical to SEQ ID NO: 27
  source: /note="Description of Artificial Sequence: Synthetic polynucleotide"
  modified_base (132)..(151): a, c, u, g, unknown or other

SEQ ID NO: 54 - RNA, 161 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcacguacgagauauaggaagcugcuguccgcuc

SEQ ID NO: 55 - RNA, 161 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcacacuacaacagccacaacgucuauaucaugg

SEQ ID NO: 56 - RNA, 135 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguaaaagcuucguggcuagcaccccguauaaagcaugagacc

SEQ ID NO: 57 - RNA, 135 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguaaaagcuucguggcuagcaccucagacuguuugccccuua

SEQ ID NO: 58 - RNA, 156 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcaccccguauaaagcaugagaccgugac

SEQ ID NO: 59 - RNA, 156 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcaccucagacuguuugccccuuacugcu

SEQ ID NO: 60 - DNA, 25 bp, Artificial Sequence
  source: /note="Description of Artificial Sequence: Synthetic oligonucleotide"
cccgtataaagcatgagaccgtgac

SEQ ID NO: 61 - DNA, 25 bp, Artificial Sequence
  source: /note="Description of Artificial Sequence: Synthetic oligonucleotide"
ctcagactgtttgccccttactgct

SEQ ID NO: 62 - RNA, 95 nt, Artificial Sequence; identical to SEQ ID NO: 26
  source: /note="Description of Artificial Sequence: Synthetic oligonucleotide"

SEQ ID NO: 63 - RNA, 16 nt, Artificial Sequence
  source: /note="Description of Artificial Sequence: Synthetic oligonucleotide"
gcuucguggcuagcac

SEQ ID NO: 64 - RNA, 135 nt, Artificial Sequence
  source: /note="Description of Artificial Sequence: Synthetic polynucleotide"
  modified_base (116)..(135): a, c, u, g, unknown or other
cgacgguuagaggccguaugucgauuugcuuuaauuucgugcgugugcauugucguccuccauuacagggcggcuaccacgaauagccacgaaguaaaagcuucguggcuagcacnnnnnnnnnnnnnnnnnnnn

SEQ ID NO: 65 - RNA, 135 nt, Artificial Sequence
  source: /note="Description of Artificial Sequence: Synthetic polynucleotide"
  modified_base (116)..(135): a, c, u, g, unknown or other
cgacgguuagaggccguaugucgauuugcuuuaauuucgugcgugugcauugucguccuccauuacagggcggcuaccacgaauagucacgaaguaaaagcuucgagguuagcacnnnnnnnnnnnnnnnnnnnn

SEQ ID NO: 66 - RNA, 144 nt, Artificial Sequence
  source: /note="Description of Artificial Sequence: Synthetic polynucleotide"
  modified_base (125)..(144): a, c, u, g, unknown or other
cgacgguuagaggccguaugucgauuugcuuuaauuucgugcgugugcauugucguccuccauuacagggcggcuaccacgaauagccacgaaguuccaaaauggaaagcuucguggcuagcacnnnnnnnnnnnnnnnnnnnn

SEQ ID NO: 67 - DNA, 30 bp, Artificial Sequence
  source: /note="Description of Artificial Sequence: Synthetic oligonucleotide"
gtacgagatataggaagctgctgtccgctc

SEQ ID NO: 68 - DNA, 29 bp, Artificial Sequence
  source: /note="Description of Artificial Sequence: Synthetic oligonucleotide"
actacaacagccacaacgtctatatcatg

SEQ ID NO: 69 - RNA, 149 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcacacuacaacagccacaacg

SEQ ID NO: 70 - RNA, 151 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcacguacgagauauaggaagcug

SEQ ID NO: 71 - RNA, 151 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcacacuacaacagccacaacguc

SEQ ID NO: 72 - RNA, 156 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcacguacgagauauaggaagcugcuguc

SEQ ID NO: 73 - RNA, 156 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguuccacugaguaaaguggaaagcuucgagguuagcacacuacaacagccacaacgucuauau

SEQ ID NO: 74 - RNA, 140 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagucacgaaguaaaagcuucgagguuagcacacuacaacagccacaacgucuauau

SEQ ID NO: 75 - RNA, 149 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguuccaaaauggaaagcuucguggcuagcacacuacaacagccacaacgucuauau

SEQ ID NO: 76 - RNA, 140 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguaaaagcuucguggcuagcacacuacaacagccacaacgucuauau

SEQ ID NO: 77 - RNA, 135 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguaaaagcuucguggcuagcacacuacaacagccacaacguc

SEQ ID NO: 78 - RNA, 140 nt, Artificial Sequence
  source: /note="Description of Artificial Sequence: Synthetic polynucleotide"
cgacgguuagaggccguaugucgauuugcuuuaauuucgugcgugugcauugucguccuccauuacagggcggcuaccacgaauagccacgaaguaaaagcuucguggcuagcacguacgagauauaggaagcugcuguc

SEQ ID NO: 79 - RNA, 111 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacggcucagcaggcaccugccucag

SEQ ID NO: 80 - RNA, 111 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacuucuccccugggaagcaucccug

SEQ ID NO: 81 - RNA, 111 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacuucauggagaaaauauucagaau

SEQ ID NO: 82 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacuguuuggaguuacuuagggccaugc

SEQ ID NO: 83 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacgagauguccccagugaacuccaaau

SEQ ID NO: 84 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacccugucguugccccucccagaucau

SEQ ID NO: 85 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacggaggcugagacaggagaguugcuu

SEQ ID NO: 86 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacauagccccccuugagcacacagagg

SEQ ID NO: 87 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacguucacacguguaaucccagcacuu

SEQ ID NO: 88 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacuuguuggucuggaugcgcugacuga

SEQ ID NO: 89 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacgaugucugggccucuguacuuugga

SEQ ID NO: 90 - RNA, 113 nt, Artificial Sequence
  source: /note="Description of Artificial Sequence: Synthetic polynucleotide"
gaccuauagggucaaugaaucugugcgugugccauaaguaauuaaaaauuacccaccacaggagcaccugaaaacaggugcuuggcacggugugugcugacccugaucucccu

SEQ ID NO: 91 - DNA, 25 bp, Homo sapiens
acctctccagggcgaactctgacac

SEQ ID NO: 92 - DNA, 25 bp, Homo sapiens
tgtgtcagagttcgccctggagagg

SEQ ID NO: 93 - DNA, 25 bp, Homo sapiens
gggaagtaggactgttggaaacggg

SEQ ID NO: 94 - DNA, 25 bp, Homo sapiens
ccaacagtcctacttccctgtttca

SEQ ID NO: 95 - DNA, 25 bp, Homo sapiens
tctttggacagtgtccatactggtg

SEQ ID NO: 96 - DNA, 25 bp, Homo sapiens
cgaggtgtgctcaccagaatggagt

SEQ ID NO: 97 - DNA, 25 bp, Homo sapiens
tggtgagcacacctcgggactgggc

SEQ ID NO: 98 - DNA, 25 bp, Homo sapiens
tgaaagagtgatgcctccaggttgt

SEQ ID NO: 99 - DNA, 25 bp, Homo sapiens
acccccgaatcgtgagtactgtcct

SEQ ID NO: 100 - DNA, 25 bp, Homo sapiens
tgagaagggccaaggtattgtggca

SEQ ID NO: 101 - DNA, 25 bp, Homo sapiens
ctgccacaataccttggcccttctc

SEQ ID NO: 102 - DNA, 25 bp, Homo sapiens
tctcagttcgctgcgacccatacac

SEQ ID NO: 103 - DNA, 25 bp, Homo sapiens
ggtgtatgggtcgcagcgaactgag

SEQ ID NO: 104 - DNA, 25 bp, Homo sapiens
gctgcgacccatacacccaaaggat

SEQ ID NO: 105 - DNA, 25 bp, Homo sapiens
ctctgcagatcactggggtggatcc

SEQ ID NO: 106 - DNA, 25 bp, Homo sapiens
gccgcgccctctgcagatcactggg

SEQ ID NO: 107 - DNA, 25 bp, Homo sapiens
gctcctcacgcacctgctctggttt

SEQ ID NO: 108 - DNA, 25 bp, Homo sapiens
ataaggctgtgctgaccatcgacaa

SEQ ID NO: 109 - DNA, 25 bp, Homo sapiens
aaggctgtgctgaccatcgacaaga

SEQ ID NO: 110 - DNA, 25 bp, Homo sapiens
ttgtcgatggtcagcacagccttat

SEQ ID NO: 111 - DNA, 25 bp, Homo sapiens
acctgccccggtggctctgctacac

SEQ ID NO: 112 - DNA, 25 bp, Homo sapiens
ggctgcgctgggtgtagcagagcca

SEQ ID NO: 113 - DNA, 25 bp, Homo sapiens
tgccaatcgcgagcagcatccagct

SEQ ID NO: 114 - DNA, 25 bp, Homo sapiens
atgccgggggcaccgatgctggttt

SEQ ID NO: 115 - DNA, 25 bp, Homo sapiens
ggtggctgagtggatggagatgccg

SEQ ID NO: 116 - DNA, 25 bp, Homo sapiens
ctccctctcccagttaccatgaagt

SEQ ID NO: 117 - DNA, 25 bp, Homo sapiens
tgacttcatggtaactgggagaggg

SEQ ID NO: 118 - DNA, 25 bp, Homo sapiens
aagaagtgcaagacccgggagacgg

SEQ ID NO: 119 - DNA, 25 bp, Homo sapiens
ctcccgggtcttgcacttcttgatg

SEQ ID NO: 120 - DNA, 25 bp, Homo sapiens
tgctgccagcacggttctggactac

SEQ ID NO: 121 - DNA, 25 bp, Homo sapiens
gcacggttctggactacacaacacg

SEQ ID NO: 122 - DNA, 25 bp, Homo sapiens
tgtagtccagaaccgtgctggcagc

SEQ ID NO: 123 - DNA, 25 bp, Homo sapiens
acggttctggactacacaacacgca

SEQ ID NO: 124 - DNA, 25 bp, Homo sapiens
cagtcacggagcggttggccttcac

SEQ ID NO: 125 - DNA, 25 bp, Homo sapiens
gggcatcttcgtggactacagagct

SEQ ID NO: 126 - DNA, 25 bp, Homo sapiens
gatccaccatgatggcccttggctt

SEQ ID NO: 127 - DNA, 25 bp, Homo sapiens
aggatccaccatgatggcccttggc

SEQ ID NO: 128 - DNA, 25 bp, Homo sapiens
ccggccacgagaatagcagcccagg

SEQ ID NO: 129 - DNA, 25 bp, Homo sapiens
cctgccagcagatctgagagggagg

SEQ ID NO: 130 - DNA, 25 bp, Homo sapiens
gatctgagagggagggcagccaggc

SEQ ID NO: 131 - DNA, 25 bp, Homo sapiens
gaggctcgccacaaggagctggagg

SEQ ID NO: 132 - DNA, 25 bp, Homo sapiens
gctagagaagtccgaggctcgccac

SEQ ID NO: 133 - DNA, 25 bp, Homo sapiens
actgctcctagtgtctgtcaggacc

SEQ ID NO: 134 - DNA, 25 bp, Homo sapiens
ctcctagtgtctgtcaggacctgaa

SEQ ID NO: 135 - DNA, 25 bp, Homo sapiens
cacttcaggtcctgacagacactag

SEQ ID NO: 136 - DNA, 25 bp, Homo sapiens
cccttgaggacctgtgaaatccaga

SEQ ID NO: 137 - DNA, 25 bp, Homo sapiens
cacaggtcctcaagggcagaagagt

SEQ ID NO: 138 - DNA, 25 bp, Homo sapiens
gacctgagagtgggtgttggacagt

SEQ ID NO: 139 - DNA, 25 bp, Homo sapiens
tccaacacccactctcaggtcacca

SEQ ID NO: 140 - DNA, 25 bp, Homo sapiens
cagccatgggagccccttcacttca

SEQ ID NO: 141 - DNA, 25 bp, Homo sapiens
gctgagtttgtgtgtgaatggacac

SEQ ID NO: 142 - DNA, 25 bp, Homo sapiens
tgatcaaacgccccggcaggaagtg

SEQ ID NO: 143 - DNA, 25 bp, Homo sapiens
gtcggcctcagcttttcacttcctg

SEQ ID NO: 144 - DNA, 25 bp, Homo sapiens
aggccattcccaagaaacggggctg

SEQ ID NO: 145 - DNA, 25 bp, Homo sapiens
cagccccgtttcttgggaatggcct

SEQ ID NO: 146 - DNA, 25 bp, Homo sapiens
ccaagaaacggggctgaaagccggg

SEQ ID NO: 147 - DNA, 25 bp, Homo sapiens
cccaggaggaggtccagctggagat

SEQ ID NO: 148 - DNA, 25 bp, Homo sapiens
cttccatctccagctggacctcctc

SEQ ID NO: 149 - DNA, 25 bp, Homo sapiens
gctactgggtggtgataatggtgaa

SEQ ID NO: 150 - DNA, 25 bp, Homo sapiens
tccttcaccattatcaccacccagt

SEQ ID NO: 151 - DNA, 25 bp, Homo sapiens
ggctactgggtggtgataatggtga

SEQ ID NO: 152 - DNA, 25 bp, Homo sapiens
tcacggtttgggggtatacatgggc

SEQ ID NO: 153 - DNA, 25 bp, Homo sapiens
gcttagggttaccgaagaggggcca

SEQ ID NO: 154 - DNA, 25 bp, Homo sapiens
cacatttggcttagggttaccgaag

SEQ ID NO: 155 - DNA, 25 bp, Homo sapiens
ggcttagggttaccgaagaggggcc

SEQ ID NO: 156 - DNA, 25 bp, Homo sapiens
gctcagggttactgaagaggggcca

SEQ ID NO: 157 - DNA, 25 bp, Homo sapiens
cacatttggctcagggttactgaag

SEQ ID NO: 158 - DNA, 25 bp, Homo sapiens
ggctcagggttactgaagaggggcc

SEQ ID NO: 159 - DNA, 20 bp, Homo sapiens
cctaaaggaaatgactgcag

SEQ ID NO: 160 - DNA, 25 bp, Homo sapiens
aggaccatcaccccctagactatag

SEQ ID NO: 161 - DNA, 25 bp, Homo sapiens
catcaccccctagactatagttagc

SEQ ID NO: 162 - DNA, 20 bp, Homo sapiens
acttcgtctattcccagatc

SEQ ID NO: 163 - DNA, 25 bp, Homo sapiens
ctagtaggggctggtgacagtcaat

SEQ ID NO: 164 - DNA, 25 bp, Homo sapiens
attgtggactgcatcttagccctag

SEQ ID NO: 165 - DNA, 20 bp, Homo sapiens
tggactgcatcttagcccta

SEQ ID NO: 166 - DNA, 25 bp, Homo sapiens
acagcccagcctacctacccaaaat

SEQ ID NO: 167 - DNA, 25 bp, Homo sapiens
tgggtaggtaggctgggctgtgggt

SEQ ID NO: 168 - DNA, 25 bp, Homo sapiens
attttgggtaggtaggctgggctgt

SEQ ID NO: 169 - DNA, 25 bp, Homo sapiens
ttgctcattgacctccactcagtgt

SEQ ID NO: 170 - DNA, 25 bp, Homo sapiens
ccgtccatttaactggaatccgacc

SEQ ID NO: 171 - DNA, 25 bp, Homo sapiens
ttctaacccccacccccactgccgg

SEQ ID NO: 172 - DNA, 25 bp, Homo sapiens
cccccactgccgggtaagggtgtca

SEQ ID NO: 173 - DNA, 25 bp, Homo sapiens
taacccccacccccactgccgggta

SEQ ID NO: 174 - DNA, 25 bp, Homo sapiens
ttgctcgttgatctccactcagtgt

SEQ ID NO: 175 - DNA, 25 bp, Homo sapiens
gcagcatcttcttccgggtcatctt

SEQ ID NO: 176 - DNA, 25 bp, Homo sapiens
ggacctacacaagcagcatcttctt

SEQ ID NO: 177 - DNA, 25 bp, Homo sapiens
tccaccacggctgtcgacaccaatc

SEQ ID NO: 178 - DNA, 25 bp, Homo sapiens
gctgtcgacaccaatcccaaggaat

SEQ ID NO: 179 - DNA, 20 bp, Homo sapiens
caccacggctgtcgacacca

SEQ ID NO: 180 - DNA, 25 bp, Homo sapiens
accacggctgtcgacaccaatccca

SEQ ID NO: 181 - DNA, 25 bp, Homo sapiens
actccaaaggctttcctccactgtt

SEQ ID NO: 182 - DNA, 20 bp, Homo sapiens
caacagtggaggaaagcctt

SEQ ID NO: 183 - DNA, 25 bp, Homo sapiens
catcccgtactcccacgaccagata

SEQ ID NO: 184 - DNA, 25 bp, Homo sapiens
ctatctggtcgtgggagtacgggat

SEQ ID NO: 185 - DNA, 25 bp, Homo sapiens
aagcagcaggaagcagacccaggag

SEQ ID NO: 186 - DNA, 25 bp, Homo sapiens
tcaaataagcagcaggaagcagacc

SEQ ID NO: 187 - DNA, 20 bp, Homo sapiens
aaataagcagcaggaagcag

SEQ ID NO: 188 - DNA, 25 bp, Homo sapiens
cctgggtctgcttcctgctgcttat

SEQ ID NO: 189 - DNA, 25 bp, Homo sapiens
tgggccaagactccacctatatcga

SEQ ID NO: 190 - DNA, 25 bp, Homo sapiens
ggctttcctcgatataggtggagtc

SEQ ID NO: 191 - DNA, 20 bp, Homo sapiens
ctcgatataggtggagtctt

SEQ ID NO: 192 - DNA, 25 bp, Homo sapiens
tattcaccggcccgctgatggtccc

SEQ ID NO: 193 - DNA, 25 bp, Homo sapiens
agccctcagtgcagccagatattca

SEQ ID NO: 194 - DNA, 25 bp, Homo sapiens
gatattcaccggcccgctgatggtc

SEQ ID NO: 195 - DNA, 25 bp, Homo sapiens
cttcctcccgacgcagatgagcccg

SEQ ID NO: 196 - DNA, 25 bp, Homo sapiens
gccactgggagcgctggcgtggaca

SEQ ID NO: 197 - DNA, 25 bp, Homo sapiens
tagacagaggacaatggcttccatg

SEQ ID NO: 198 - DNA, 25 bp, Homo sapiens
gacagaggacaatggcttccatggt

SEQ ID NO: 199 - DNA, 25 bp, Homo sapiens
tggttgtgcagccagatgcctagac

SEQ ID NO: 200 - DNA, 25 bp, Homo sapiens
atagctgtgtggtgcttctgtggtg

SEQ ID NO: 201 - DNA, 25 bp, Homo sapiens
tcttgctcactttggaccttggtgg

SEQ ID NO: 202 - DNA, 25 bp, Homo sapiens
cccgacttacagccagtaatgtcac

SEQ ID NO: 203 - DNA, 25 bp, Homo sapiens
ctggctgtaagtcgggctttcttca

SEQ ID NO: 204 - DNA, 25 bp, Homo sapiens
agcaacctccagtggtgaccagaat

SEQ ID NO: 205 - DNA, 25 bp, Homo sapiens
ctgcaagcaacctccagtggtgacc

SEQ ID NO: 206 - DNA, 25 bp, Homo sapiens
tcagaaaaactggctcgagagctcc

SEQ ID NO: 207 - DNA, 20 bp, Homo sapiens
aggagctctcgagccagttt

SEQ ID NO: 208 - DNA, 25 bp, Homo sapiens
attagtcagaggaaggttgagccca

SEQ ID NO: 209 - DNA, 25 bp, Homo sapiens
ctcaaccttcctctgactaatggtg

SEQ ID NO: 210 - DNA, 20 bp, Homo sapiens
gtcagaggaaggttgagccc

SEQ ID NO: 211 - DNA, 25 bp, Homo sapiens
agtggctccgaaggcaccgtcttct

SEQ ID NO: 212 - DNA, 25 bp, Homo sapiens
gggtctgtttgaacatggagaacac

SEQ ID NO: 213 - DNA, 25 bp, Homo sapiens
gaaagatctagctcaccgtcctctt

SEQ ID NO: 214 - DNA, 25 bp, Homo sapiens
agtacaccaccgtcggccacatgga

SEQ ID NO: 215 - DNA, 25 bp, Homo sapiens
cgctcagtacaccaccgtcggccac

SEQ ID NO: 216 - DNA, 25 bp, Homo sapiens
tgcaagcccaccttggtccatgtgg

SEQ ID NO: 217 - DNA, 25 bp, Homo sapiens
ttcagccctgggacacatgatggag

SEQ ID NO: 218 - DNA, 25 bp, Homo sapiens
ttccctccatcatgtgtcccagggc

SEQ ID NO: 219 - DNA, 25 bp, Homo sapiens
ttcagccctgggacacatgatggag

SEQ ID NO: 220 - DNA, 25 bp, Homo sapiens
ggaagtggttggacaagtaagcgcc

SEQ ID NO: 221 - DNA, 25 bp, Homo sapiens
ggcgcttacttgtccaaccacttcc

SEQ ID NO: 222 - DNA, 25 bp, Homo sapiens
caaactgaaatctgtaagcaggcgg

SEQ ID NO: 223 - DNA, 25 bp, Homo sapiens
cccgcctgcttacagatttcagttt

SEQ ID NO: 224 - DNA, 25 bp, Homo sapiens
tggcaggcatcattggtcagatcca

SEQ ID NO: 225 - DNA, 25 bp, Homo sapiens
ccagcaccatcactcgccgggctgt

SEQ ID NO: 226 - DNA, 25 bp, Homo sapiens
tgccagcaccatcactcgccgggct

SEQ ID NO: 227 - DNA, 25 bp, Homo sapiens
atgcccccgaagcccctctccaccg

SEQ ID NO: 228 - DNA, 25 bp, Homo sapiens
cgcaaaagctgtgatcttctccttc

SEQ ID NO: 229 - DNA, 25 bp, Homo sapiens
aagcccctctccaccgcaaaagctg

SEQ ID NO: 230 - DNA, 25 bp, Homo sapiens
aaaggaccgcaatgtggccacccca

SEQ ID NO: 231 - DNA, 25 bp, Homo sapiens
caccccaagagactactactttgct

SEQ ID NO: 232 - DNA, 25 bp, Homo sapiens
tggggtggccacattgcggtccttt

SEQ ID NO: 233 - DNA, 25 bp, Homo sapiens
gtaatggtgtggctgtactctccaa

SEQ ID NO: 234 - DNA, 20 bp, Homo sapiens
gagagtacagccacaccatt

SEQ ID NO: 235 - DNA, 25 bp, Homo sapiens
tatcacttacggatcacagaggggg

SEQ ID NO: 236 - DNA, 25 bp, Homo sapiens
gtgacagagctggtttcaaagttgc

SEQ ID NO: 237 - DNA, 25 bp, Homo sapiens
gcgaagatggcttggatgagtggcc

SEQ ID NO: 238 - DNA, 25 bp, Homo sapiens
cttggatgagtggccgcagcgctgt

SEQ ID NO: 239 - DNA, 25 bp, Homo sapiens
cctgtggcagagttccctgaagcca

SEQ ID NO: 240 - DNA, 25 bp, Homo sapiens
tcagggaactctgccacaggtgagc

SEQ ID NO: 241 - DNA, 25 bp, Homo sapiens
cctgaagccatcaaggggctgcagc

SEQ ID NO: 242 - DNA, 25 bp, Homo sapiens
tcgccatcgctgtagaacgcaccac

SEQ ID NO: 243 - DNA, 25 bp, Homo sapiens
gtccaagcagcgccactgtgggaga

SEQ ID NO: 244 - DNA, 25 bp, Homo sapiens
tttactctcccacagtggcgctgct

SEQ ID NO: 245 - DNA, 25 bp, Homo sapiens
cctccaattcaggacccacatgacg

SEQ ID NO: 246 - DNA, 25 bp, Homo sapiens
ctccaattcaggacccacatgacgg

SEQ ID NO: 247 - DNA, 25 bp, Homo sapiens
agtgctccccgcaccggcccatcct

SEQ ID NO: 248 - DNA, 25 bp, Homo sapiens
ctgcccccacagagtgctccccgca

SEQ ID NO: 249 - DNA, 25 bp, Homo sapiens
gaccaagcagccatgccagtacttc

SEQ ID NO: 250 - DNA, 25 bp, Homo sapiens
atctcctcctcatcctccagcctct

SEQ ID NO: 251 - DNA, 25 bp, Homo sapiens
gacaacaagatgccccctgaggcct

SEQ ID NO: 252 - DNA, 25 bp, Homo sapiens
ctggggctgcttactactaccaatg

SEQ ID NO: 253 - DNA, 25 bp, Homo sapiens
gacaagatgtggaggctgacccatg

SEQ ID NO: 254 - DNA, 25 bp, Homo sapiens
ctggggctgcttactactaccaatg

SEQ ID NO: 255 - DNA, 25 bp, Homo sapiens
gggggctggtttgccatccaagggg

SEQ ID NO: 256 - DNA, 25 bp, Homo sapiens
aatgaacatccctgtccggccaatt

SEQ ID NO: 257 - DNA, 25 bp, Homo sapiens
gccggacagggatgttcattgtgat

SEQ ID NO: 258 - DNA, 25 bp, Homo sapiens
aatcacaatgaacatccctgtccgg

SEQ ID NO: 259 - DNA, 25 bp, Homo sapiens
gattactgtgacctgtatggagggg

SEQ ID NO: 260 - DNA, 25 bp, Homo sapiens
gccattttggctgagttggtccagt

SEQ ID NO: 261 - DNA, 25 bp, Homo sapiens
tttggctgagttggtccggtattac

SEQ ID NO: 262 - DNA, 25 bp, Homo sapiens
gccactttggctgagttggtccggt

SEQ ID NO: 263 - DNA, 25 bp, Homo sapiens
ttggctgagttggtccggtattaca

SEQ ID NO: 264 - DNA, 25 bp, Homo sapiens
ccgcagatgaggagcagctctaggc

SEQ ID NO: 265 - DNA, 25 bp, Homo sapiens
agctctaggccgaagtgtcgcaggc

SEQ ID NO: 266 - DNA, 25 bp, Homo sapiens
tacgtcctcagctgggactagcagc

SEQ ID NO: 267 - DNA, 25 bp, Homo sapiens
gactagcagctcaacctcgcctatg

SEQ ID NO: 268 - DNA, 25 bp, Homo sapiens
agctgctagtcccagctgaggacgt

SEQ ID NO: 269 - DNA, 25 bp, Homo sapiens
tctctcctgggcatcaagggagtcc

SEQ ID NO: 270 - DNA, 25 bp, Homo sapiens
ttggactcccttgatgcccaggaga

SEQ ID NO: 271 - DNA, 25 bp, Homo sapiens
aatgactgtgatccacattccccct

SEQ ID NO: 272 - DNA, 20 bp, Homo sapiens
cctaccctgaaaatccgaaa

SEQ ID NO: 273 - DNA, 25 bp, Homo sapiens
cacacactctgcaccttgaaggctg

SEQ ID NO: 274 - DNA, 25 bp, Homo sapiens
gcaccttgaaggctgacaagtcatc

SEQ ID NO: 275 - DNA, 25 bp, Homo sapiens
tagtagcacacactctgcaccttga

SEQ ID NO: 276 - DNA, 25 bp, Homo sapiens
ttggtgctctcctccgtggccacgc

SEQ ID NO: 277 - DNA, 25 bp, Homo sapiens
agcatcgatgtcaacgagggcaacc

SEQ ID NO: 278 - DNA, 25 bp, Homo sapiens
ccctcgttgacatcgatgcttgaga

SEQ ID NO: 279 - DNA, 25 bp, Homo sapiens
gggggctgagcagcagtgcgccctt

SEQ ID NO: 280 - DNA, 25 bp, Homo sapiens
agctgcttttccggggtttccgctg

SEQ ID NO: 281 - DNA, 25 bp, Homo sapiens
gacagcggaaaccccggaaaagcag

SEQ ID NO: 282 - DNA, 25 bp, Homo sapiens
gtggaacttctgtactacaacgctg

SEQ ID NO: 283 - DNA, 25 bp, Homo sapiens
gtctcagcaggatctctcaccgtag

SEQ ID NO: 284 - DNA, 25 bp, Homo sapiens
acctgagtgttttagctacggtgag

SEQ ID NO: 285 - DNA, 25 bp, Homo sapiens
gtggagctgaccagggaggagacct

SEQ ID NO: 286 - DNA, 25 bp, Homo sapiens
tgaccagggaggagaccttcaaata

SEQ ID NO: 287 - DNA, 20 bp, Homo sapiens
gaaggtctcctccctggtca

SEQ ID NO: 288 - DNA, 25 bp, Homo sapiens
gtggagctgaccagggaggagacct

SEQ ID NO: 289 - DNA, 25 bp, Homo sapiens
cgctggttctgccggctgattcagc

SEQ ID NO: 290 - DNA, 25 bp, Homo sapiens
ctgctgaatcagccggcagaaccag

SEQ ID NO: 291 - DNA, 25 bp, Homo sapiens
ggatgggtggagagcaagttggtca

SEQ ID NO: 292 - DNA, 25 bp, Homo sapiens
tgcaggagcttcgaggcactgtggc

SEQ ID NO: 293 - DNA, 25 bp, Homo sapiens
atgctggatgtgctgcaggagcttc

SEQ ID NO: 294 - DNA, 25 bp, Homo sapiens
ctgccatattgtgtgcccgcactcg

SEQ ID NO: 295 - DNA, 25 bp, Homo sapiens
gggggcccggctgctttttcgagtg

SEQ ID NO: 296 - DNA, 20 bp, Homo sapiens
tgtgcccgcactcgaaaaag

SEQ ID NO: 297 - DNA, 25 bp, Homo sapiens
ctcagaggtcagggagggtccagac

SEQ ID NO: 298 - DNA, 20 bp, Homo sapiens
cttgggactgtaaaagctgt

SEQ ID NO: 299 - DNA, 25 bp, Homo sapiens
gtaagtgatccatcctaggttggca

SEQ ID NO: 300 - DNA, 20 bp, Homo sapiens
gtaagtgatccatcctaggt

SEQ ID NO: 301 - DNA, 25 bp, Homo sapiens
gccccctcaccttggacagtgagat

SEQ ID NO: 302 - DNA, 25 bp, Homo sapiens
cttcaatctcactgtccaaggtgag

SEQ ID NO: 303 - DNA, 25 bp, Homo sapiens
tttaacgaagccctccgtgagagct

SEQ ID NO: 304 - DNA, 20 bp, Homo sapiens
aacgaagccctccgtgagag

SEQ ID NO: 305 - DNA, 20 bp, Homo sapiens
caagaatctgaccatcttgg

SEQ ID NO: 306 - DNA, 25 bp, Homo sapiens
actgtgggagttctcgtccgtgacc

SEQ ID NO: 307 - DNA, 20 bp, Homo sapiens
tcgtccgtgacctgggagcc

SEQ ID NO: 308 - DNA, 25 bp, Homo sapiens
cagatgaacactggtcagcgtaggg

SEQ ID NO: 309 - DNA, 20 bp, Homo sapiens
acagatgaacactggtcagc

SEQ ID NO: 310 - DNA, 25 bp, Homo sapiens
cagaacatccttgggggctacaggt

SEQ ID NO: 311 - DNA, 25 bp, Homo sapiens
gccagcatggctgccagaacatcct

SEQ ID NO: 312 - DNA, 25 bp, Homo sapiens
cggaacctgtgaggaggttggcact

SEQ ID NO: 313 - DNA, 25 bp, Homo sapiens
gttgacatcggaacctgtgaggagg

SEQ ID NO: 314 - DNA, 20 bp, Homo sapiens
tcagtgccaacctcctcaca

SEQ ID NO: 315 - DNA, 25 bp, Homo sapiens
cggaacctgtgaggaggttggcact

SEQ ID NO: 316 - DNA, 25 bp, Homo sapiens
taggcgatggagcctgggggttcgg

SEQ ID NO: 317 - DNA, 25 bp, Homo sapiens
ggtaggcgatggagcctgggggttc

SEQ ID NO: 318 - DNA, 25 bp, Homo sapiens
gactggggaactcccgacaagatca

SEQ ID NO: 319 - DNA, 25 bp, Homo sapiens
gggaactcccgacaagatcaagaaa

SEQ ID NO: 320 - DNA, 20 bp, Homo sapiens
ttgatcttgtcgggagttcc

SEQ ID NO: 321 - DNA, 25 bp, Homo sapiens
tcccgacaagatcaagaaagggggc

SEQ ID NO: 322 - DNA, 25 bp, Homo sapiens
ctgagcaccctgtacagcttcttcc

SEQ ID NO: 323 - DNA, 3 bp, Streptococcus pyogenes
  modified_base (1)..(1): a, c, t, g, unknown or other
ngg

SEQ ID NO: 324 - DNA, 5 bp, Staphylococcus aureus
  modified_base (1)..(1): a, c, t, g, unknown or other
ngrrt

SEQ ID NO: 325 - protein, 169 aa, Artificial Sequence
  source: /note="Description of Artificial Sequence: Synthetic polypeptide"
MTEHEKFMNAALKLARKAAAEGEVPVGCVVVRDGVIVGRGRNRRETKKDALGHAEIEAIHKACKKLGGWRLHQCDLYVTLEPCPMCTGAIINARIKTVYYGAPRLSAGSCGSVVNLFDLPYNHKPELVSGLMEQECTEELQKFFRQLRERKKLEKQLRKQAQMNDLNEI

SEQ ID NO: 326 - protein, 1254 aa, Artificial Sequence
  source: /note="Description of Artificial Sequence: Synthetic polypeptide"
MTEHEKFMNAALKLARKAAAEGEVPVGCVVVRDGVIVGRGRNRRETKKDALGHAEIEAIHKACKKLGGWRLHQCDLYVTLEPCPMCTGAIINARIKTVYYGAPRLSAGSCGSVVNLFDLPYNHKPELVSGLMEQECTEELQKFFRQLRERKKLEKQLRKQAQMNDLNEISGSETPGTSESATPESSGGSSGGSSMKQTSYSLGLAIGIASVGYGLIDNDENIVDAGVRLFPEANSKNNDGRRKSRGSKRLIRRKRHRIARVKHLLKESGIDVSYENTVLTNPYEIRCKGLTLPLTNHELSIALLHLAKRRGVHNVKSMDQEKVKGNELSTKEQLTINDNLLEEKFICELQLERLNKEGIVRSHSNRFKTADYIKEIKNLLETQAKQNTLVTEEFIEKYIEIFSGRRKYYEGPGGESKYGWKGDIEKWYEGLMGKCTYFPKELRCVKHAYSAALFNLLNDLNNLSINREEDTKLSQYEKEQIIEKIFKVRKTPTLTQIAKLLKVDPTNIKGFRTKANGTPDFLSIKIYHDLKGIIDDKQLLDDIAFLDNVAQILTVWQDSQSIQEKLKTLNKNLDDKTIKEISELKKYTQTHSLSLKLINVLLPELWETTKNQMTILSELKLKPRKIDLHNCNEIPVNMINDLIVSPVVRRSLTQSIEMINQIIKDYGHPREIVIELAREKNSEEKKNFIKSLNEKNKQINDEVIEKLNASNHRDNKGMFNKVKLWILQDGHCLYSLKPIRLEDLLNNPNHYEIDAIIPKSVSFDDSMSNKVLVYQIENSKKGNRTPYQYLTSADKTITYEKFKANITQLAKSNHKISKKKLDYLLEERDINRFHIKKEFINRNLVDTRYATRSLINLLKYYFSEKDINVKVKSINGSFTDYLRKLWNFPKDREFYHKHHAEDALIIAMANKIFTTRKIFKEQNSVFSDEQILDGEVTNILSDDQFQAEFTEKFYKVQAIKKYDKYKYSHRVDKKPNRQLFDDTLYSTREFEGEEYYIGKIKDIYNLKDKRLKKIFTKSPEKILMYQHDSQTFKKLKQIMRSYEDEVNPLAKYHKETGEYLRKECKKGNGPIVKSLKYRVTKLGVHKDITHKYENSKNKVVILSLKPFRMDVFKENGVYKFITIRYCDLKETVNSYTISEHLYKAKLKAKDIKSMDSFKWSFYKNDLLEYNGELCTFKGVNDDKKNKIEVNWVEKNFAIYAEKKNLKSKQLVKSITKSTVKSLLKYTTDILGNRYPVRNEKLKLMIRKQTFRGDL

SEQ ID NO: 327 - protein, 1060 aa, Artificial Sequence
  source: /note="Description of Artificial Sequence: Synthetic polypeptide"
MKQTSYSLGLAIGIASVGYGLIDNDENIVDAGVRLFPEANSKNNDGRRKSRGSKRLIRRKRHRIARVKHLLKESGIDVSYENTVLTNPYEIRCKGLTLPLTNHELSIALLHLAKRRGVHNVKSMDQEKVKGNELSTKEQLTINDNLLEEKFICELQLERLNKEGIVRSHSNRFKTADYIKEIKNLLETQAKQNTLVTEEFIEKYIEIFSGRRKYYEGPGGESKYGWKGDIEKWYEGLMGKCTYFPKELRCVKHAYSAALFNLLNDLNNLSINREEDTKLSQYEKEQIIEKIFKVRKTPTLTQIAKLLKVDPTNIKGFRTKANGTPDFLSIKIYHDLKGIIDDKQLLDDIAFLDNVAQILTVWQDSQSIQEKLKTLNKNLDDKTIKEISELKKYTQTHSLSLKLINVLLPELWETTKNQMTILSELKLKPRKIDLHNCNEIPVNMINDLIVSPVVRRSLTQSIEMINQIIKDYGHPREIVIELAREKNSEEKKNFIKSLNEKNKQINDEVIEKLNASNHRDNKGMFNKVKLWILQDGHCLYSLKPIRLEDLLNNPNHYEIDAIIPKSVSFDDSMSNKVLVYQIENSKKGNRTPYQYLTSADKTITYEKFKANITQLAKSNHKISKKKLDYLLEERDINRFHIKKEFINRNLVDTRYATRSLINLLKYYFSEKDINVKVKSINGSFTDYLRKLWNFPKDREFYHKHHAEDALIIAMANKIFTTRKIFKEQNSVFSDEQILDGEVTNILSDDQFQAEFTEKFYKVQAIKKYDKYKYSHRVDKKPNRQLFDDTLYSTREFEGEEYYIGKIKDIYNLKDKRLKKIFTKSPEKILMYQHDSQTFKKLKQIMRSYEDEVNPLAKYHKETGEYLRKECKKGNGPIVKSLKYRVTKLGVHKDITHKYENSKNKVVILSLKPFRMDVFKENGVYKFITIRYCDLKETVNSYTISEHLYKAKLKAKDIKSMDSFKWSFYKNDLLEYNGELCTFKGVNDDKKNKIEVNWVEKNFAIYAEKKNLKSKQLVKSITKSTVKSLLKYTTDILGNRYPVRNEKLKLMIRKQTFRGDL

SEQ ID NO: 328 - DNA, 15 bp, Artificial Sequence
  source: /note="Description of Artificial Sequence: Synthetic oligonucleotide"
gactccttcaccaag

SEQ ID NO: 329 - DNA, 14 bp, Artificial Sequence
  source: /note="Description of Artificial Sequence: Synthetic oligonucleotide"
gtagatcagcaccg

SEQ ID NO: 330 - DNA, 14 bp, Artificial Sequence
  source: /note="Description of Artificial Sequence: Synthetic oligonucleotide"
ctctgggccgaagt

SEQ ID NO: 331 - DNA, 14 bp, Artificial Sequence
  source: /note="Description of Artificial Sequence: Synthetic oligonucleotide"
ctctaggccgaagt

SEQ ID NO: 332 - DNA, 13 bp, Artificial Sequence
  source: /note="Description of Artificial Sequence: Synthetic oligonucleotide"
acttcctccagcc

SEQ ID NO: 333 - DNA, 13 bp, Artificial Sequence
  source: /note="Description of Artificial Sequence: Synthetic oligonucleotide"
gaaccccggctta

SEQ ID NO: 334 - DNA, 203 bp, Artificial Sequence
  source: /note="Description of Artificial Sequence: Synthetic polynucleotide"
tgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 335 - DNA, 304 bp, Artificial Sequence
  source: /note="Description of Artificial Sequence: Synthetic polynucleotide"
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatg

SEQ ID NO: 336 - DNA, 318 bp, Artificial Sequence
  source: /note="Description of Artificial Sequence: Synthetic polynucleotide"
tgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 337 - DNA, 31 bp, Artificial Sequence
  source: /note="Description of Artificial Sequence: Synthetic oligonucleotide"
ggagcagctctaggccgaagtgtcgcaggcc

SEQ ID NO: 338 - DNA, 31 bp, Artificial Sequence
  source: /note="Description of Artificial Sequence: Synthetic oligonucleotide"
agaacaactctaggcagaggtctcaaaggct

SEQ ID NO: 339 - DNA, 31 bp, Artificial Sequence; identical to SEQ ID NO: 337
  source: /note="Description of Artificial Sequence: Synthetic oligonucleotide"

SEQ ID NO: 340 - DNA, 20 bp, Homo sapiens
aagactaacctggccaacat

SEQ ID NO: 341 - DNA, 20 bp, Homo sapiens
gtcttgaactccggacctca

SEQ ID NO: 342 - DNA, 20 bp, Homo sapiens
gccgggcgtggtgtcgcgcg

SEQ ID NO: 343 - DNA, 20 bp, Homo sapiens
tcctgccgcagcctctggag

SEQ ID NO: 344 - DNA, 135 bp, Artificial Sequence
  source: /note="Description of Artificial Sequence: Synthetic polynucleotide"
cgacggttagaggccgtatgtcgatttgctttaatttcgtgcgtgtgcattgtcgtcctccattacagggcggctaccacgaatagccacgaagtaaaagcttcgtggctagcacaagactaacctggccaacat

SEQ ID NO: 345 - DNA, 135 bp, Artificial Sequence
  source: /note="Description of Artificial Sequence: Synthetic polynucleotide"
cgacggttagaggccgtatgtcgatttgctttaatttcgtgcgtgtgcattgtcgtcctccattacagggcggctaccacgaatagccacgaagtaaaagcttcgtggctagcacgtcttgaactccggacctca

SEQ ID NO: 346 - DNA, 135 bp, Artificial Sequence
  source: /note="Description of Artificial Sequence: Synthetic polynucleotide"
cgacggttagaggccgtatgtcgatttgctttaatttcgtgcgtgtgcattgtcgtcctccattacagggcggctaccacgaatagccacgaagtaaaagcttcgtggctagcacgccgggcgtggtgtcgcgcg

SEQ ID NO: 347 - DNA, 135 bp, Artificial Sequence
  source: /note="Description of Artificial Sequence: Synthetic polynucleotide"
cgacggttagaggccgtatgtcgatttgctttaatttcgtgcgtgtgcattgtcgtcctccattacagggcggctaccacgaatagccacgaagtaaaagcttcgtggctagcactcctgccgcagcctctggag

SEQ ID NO: 348 - DNA, 500 bp, Artificial Sequence
  source: /note="Description of Artificial Sequence: Synthetic polynucleotide"
aaaaatggacaattatgaggaggggagagtgcagacaggggaagcttcacctcctttacaattttgggagtccacacggcatggcatacaaattatttcattcccattgagaaataaaatccaattctccatcaccaagagagccttccgaaagaggcccccctgggcaaacggccaccgatggagaggtctgccagtcctcttctaccccacccacgcccccaccctaatcagaggccaaacccttcctggagcctgtgataaaagcaactgttagcttgcactagactagcttcaaagttgtattgaccctggtgtgttatgtctaagagtagatgccatatctcttttctggcctatgttattacctgtatggactttgcactggaatcagctatctgctcttacttatgcacacctggggcatagagccagccctgtatcgcttttcagccatctcactacagataactcccaagtcctgtctagctgccttcctt

SEQ ID NO: 349 - DNA, 3324 bp, Artificial Sequence
  source: /note="Description of Artificial Sequence: Synthetic polynucleotide"
atggccattcggagcatcaagctcaagctgaagaccagaaccggtcctgaggctcagaacctgcggaagggcatctggagaacccaccggctgctgaacgagggcgtggcctactacatgaagatgctgctgctcttccggcaggaatccactggcggccagacaaagaaggaactgcaggaggaactggtgcggcacatccgggagcagcagcagaaaaacagagccgacaagaatacccaggccctgcctctggataaggccttcgccgctctgagacaactgtacgagctgctcgtgccatctagcatcggccagagcggcgatgcccagatcatctctagaaaattcctgtctcctttggtggaccctaacagcgagggcggcaagggcactagcaaggccggagccaagcccacatggcagaaaaagaaggaggccaatgaccctacatgggagcaagattacgagaagtggaaaaagcgtagagaggaagatcctaccgccagtgtgataacaaccctggaagaatatggaattagacctatctttccactgtacaccaacaccgtggccgatatcgcctggctgcctctgcagtctaaccagtttgtccggacatgggatcgggacatgctgcagcaggccatcgagaggctactctcttgggagtcttggaacaagcgggtgcaagaggaatacagcaagctgcaggagaagatgacgcaactgaacgagcaactggagggcggacaggagtggatcagcctgctggaacaatacgaggaacagagagagcaggagctgatcgaaaacatgaccgccgcaaacgataaataccgcatcaccaagcggcagatgaagggctggaatgagctgtatgagcagtggtctaccgtgctgcccaatgccagccacgagcagtacagagaggcactgaaaagagtgcaacagcggctgaggggcagattcggcgacgctcatttcttccagtatctgatgaaagaagaacaccacctgatctggaaggggaaccctcagagaatccactacttcgtggccagaaacgagctgaagaaaagactggaagaagccaagcagaacgccaccatgaccctgcctgatgccagaaagcaccctctgtgggtcagatttgacgccagaggcggcaacctgcaagactactacctgacggccgaagccgacaaccccagaagcagaaggttcgtgaccttcagccaactgatctggcctaacgagagcggctggatggaaaaacaggacgtggaagttgaactggccctgagcaagcagttctaccagcaagtgacactgcagaaaaacgacaaggggaagcaggaaatcgagttcaaagacaagggcagtggcagcaccttcagcggccacctgggcggggccaagctgcaactggagagaggagatctggagaaggaagaaaaagactttgaaggcggcgaaatcggcagcgtgtacctgaacatcgtgatcgacttcgagccactgcaggaggtgaagaacggccgactgcaatctccttacggccaggtgctgcaactggtcagaaggcctaatgagttccccaaggtgaccacctacaagtctgaggaactggtcgagtggatcaagagcagcaccaaggacagcgccggcgtggagtccttagagagcggttttagagtgatgagcatcgacctgggactgcggaccgccgccgcaacaagcatcttctctgtagaggaatccaacgacgccaacgccgcgggtttcagctactggatcgagggaactcctctggttgccgttcataagcggtcatatatgctgaaactgcccggagagcaagtcgaaaagcaggtgcgagagaagcgggacgagcggcaggatcagcagagaagagtgaggttccaaatcagaatcctgagccaggtgatccggatggccaagaagcagaaccgggagcgggctgatgagctggaccacctgtcccaggccctggagaagcaaaaatctctgctggaccagaccgatcggaccttttggaacggcatcgtgtgcgacctgacagacgctctgagagagaaagagggcggatgggaacaggccgtggtccagatccacaggaaggccgaggagcacgtgggcaaggtggtgcaagcctggcggaaacggttcgacgccgatgaacgcaagggcatcgccggcctgtctatgtggtctatcgaggagctggacagcctgcggaagctgctgatctcttggagcagaagaacaagaaaccccagagaaatcaactgcttcgagcagggccacaccagccaccagcggctgctgacacacatccagaacgtgaaggaggaccggctgaagcaactgagccacgccattgtgatgacagccttgggctacgtgtacgacgagaagaaattggaatggtttgccaagtaccctgcttgtcaggtgatcctgttcgagaacctgtcccagtaccggtccaacatggacagaagcaccaaagagaatagcaccctgatgaaatgggcccacaggagcatccctaagtacgtgcacatgcaggccgagccttacggcatccagatcggcgatgtgcgggccgagtactccagcagattccacgccaagacaggcacacctggcatccggtgcaagatggtgtccggacacgacctgcaaggcaggcgcttcgagaacctgcagaagcggttaatctctgaacagttcctgacagaggagcaagtgaagcagctcagacccggcgacatcgtgcccgacgactccggcgagtggttcatgaccctgagcgacggcagcgaaggcaaagaggttgtgttcctccaagccgacatcaacgccgcccaaaatctgcaaaagagattctggcagcggtacaacgagctgtttaaggtctcctgcagagtgctgatccgaggagaagaggaatacctgatccccaagacaaagtccgtgcaagccaagctgggcaaaggcctgttcgtgaaaaaaaccgacaccgtgatgaaggacgtgtacgtgtgggacagccaggctaagctgaagggcaaaaccacattcaccgaggagtccgaaagccctgagcaactggaggattttcaggagatcatcgaagaagccgaagaagctaagggcacatacagaacactgtttagagaccccagcggagtgttcttccctgagttcgtgtggtccacccagaaagatttctggtccgaggtgaagagacggctgtacggcaagctgagagagcggttcctgatgaagaccagg

SEQ ID NO: 350 - DNA, 20 bp, Homo sapiens
tattgaccctggtgtgttat

SEQ ID NO: 351 - DNA, 20 bp, Homo sapiens
gcttgcactagactagcttc

SEQ ID NO: 352 - DNA, 20 bp, Homo sapiens
cttttatcacaggctccagg

SEQ ID NO: 353 - DNA, 135 bp, Artificial Sequence
  source: /note="Description of Artificial Sequence: Synthetic polynucleotide"
cgacggttagaggccgtatgtcgatttgctttaatttcgtgcgtgtgcattgtcgtcctccattacagggcggctaccacgaatagccacgaagtaaaagcttcgtggctagcactattgaccctggtgtgttat

SEQ ID NO: 354 - DNA, 135 bp, Artificial Sequence
  source: /note="Description of Artificial Sequence: Synthetic polynucleotide"
cgacggttagaggccgtatgtcgatttgctttaatttcgtgcgtgtgcattgtcgtcctccattacagggcggctaccacgaatagccacgaagtaaaagcttcgtggctagcacgcttgcactagactagcttc

SEQ ID NO: 355 - DNA, 135 bp, Artificial Sequence
  source: /note="Description of Artificial Sequence: Synthetic polynucleotide"
cgacggttagaggccgtatgtcgatttgctttaatttcgtgcgtgtgcattgtcgtcctccattacagggcggctaccacgaatagccacgaagtaaaagcttcgtggctagcaccttttatcacaggctccagg

SEQ ID NO: 356 - RNA, 118 nt, Artificial Sequence
  source: /note="Description of Artificial Sequence: Synthetic polynucleotide"
aggagcagcucuaggccgaagugucguuuuaguacucugugaaagcacagaaucuacuaaaauaaggcauaaugccguauuuaaucccaucauaauucugaugggauuuuuuauauuu

SEQ ID NO: 357 - DNA, 3180 bp, Artificial Sequence
  source: /note="Description of Artificial Sequence: Synthetic polynucleotide"
atgaagcagacatcttattctctgggcctggatatcggcatcgcctctgtgggctacggcctgattgataacgacgaaaacatcgtggacgccggcgtcagactgtttcctgaggccaatagcaagaacaacgacggaagacggaagagcagaggctccaagcggctgatccggcggaagcgccacagaatcgccagagtgaagcacctgctgaaggaaagcggcatcgacgtgtcctacgaaaataccgtgctgaccaacccttacgagatccggtgcaagggcctgaccttaccactgacgaaccacgagctttccatcgccctgcttcatctggctaagagacgaggcgtgcacaacgtgaagagcatggaccaggagaaagtcaagggcaacgagctgtctacaaaagagcaactgaccatcaatgataatctgctggaagaaaagttcatctgcgagctgcaactggagagactgaacaaggaaggcatcgtgcggagccactccaacagattcaagaccgccgactacatcaaagagatcaagaacctgctggaaacacaggccaagcagaacacacttgttaccgaggagttcatcgaaaagtacatcgagattttcagcggcagaagaaagtactatgaaggccccggcggagagagcaagtacggatggaagggagatattgaaaagtggtacgaaggcctgatgggcaagtgcacctacttccccaaggaactgagatgtgtgaaacatgcctactctgccgccctgttcaacctgctgaatgatctgaacaacctgagcatcaacagagaggaagataccaagctctcccaatacgaaaaagagcagataattgagaagatctttaaggtgcggaagacccctaccctgacacagatcgccaagctgctgaaggtggaccctacaaacatcaagggcttccggacaaaggccaacggtacacctgacttcctgagcatcaagatctaccacgacctgaaaggaatcatcgacgacaagcaacttctcgacgacatcgcattcctggacaacgtggcccagattctgacagtgtggcaggacagccagagcatccaggagaagctgaagactctgaacaagaacctggacgataagaccatcaaggagatcagcgaactgaagaagtacacccagacccacagcctgagcctgaagctgatcaacgtgctgctgcctgagctgtgggagaccacaaaaaaccagatgaccatcctgagcgagctgaagctgaagcccagaaaaatcgacctgcacaattgcaacgagatccccgtgaacatgataaacgacctgatcgtgtcccctgtggtgcggagatccttgacccaaagcatcgagatgatcaaccagattatcaaggactacggccatcctagagagatcgttatcgagctggccagagaaaaaaacagcgaggagaagaaaaatttcatcaagagcctgaacgagaagaacaaacagatcaatgacgaggtgatcgagaaactgaatgccagcaaccacagggacaacaagggcatgttcaacaaggtgaagctgtggattctgcaagacggccactgcctgtacagtctgaagcctatcaggctggaagacctgcttaacaaccccaatcactacgagatcgaccacatcatccctaagagcgtttctttcgacgatagcatgagcaacaaggtgctggtgtaccagatcgagaactctaagaaaggcaatagaacaccttaccagtacctgaccagcgctgataagacaatcacatacgagaagttcaaggctaacatcacccaactggccaagtccaaccacaagattagcaagaagaagttggattacctgttagaggaaagagatatcaaccggtttcacatcaagaaggaatttatcaatcgcaacctggtggacacccggtacgccaccagaagcctgatcaacctgctgaaatactacttcagcgagaaagatattaatgtgaaggtcaaatccatcaatggcagcttcacagattacctgcgtaaattgtggaacttcccaaaggatagagaattctaccacaaacaccacgccgaggacgccctcatcatcgctatggccaacaagatcttcacaaccaggaaaatcttcaaggaacaaaactccgtgttctcagatgaacagattctggatggcgaggtgacaaatatcctctctgatgatcagttccaggctgaattcaccgagaagttttacaaagtgcaagccatcaagaaatacgacaaatataaatactcccaccgggtggacaagaaacctaaccggcagctttttgacgacaccctgtacagcacgcgggaattcgagggagaagagtactacatcggcaaaattaaggacatctataacctgaaggacaaaagactgaaaaagatcttcaccaagagccccgagaagatcctgatgtaccaacacgacagccagaccttcaagaagctgaagcagatcatgagaagctacgaggacgaggtgaaccccctggccaagtaccacaaggagacaggcgaatacctgagaaaggagtgcaagaaaggcaacggccctatagtgaaatccctgaaatatagagtgactaagctgggcgtgcacaaggacatcacccacaagtacgagaacagcaagaacaaggtcgtgatccttagcctgaagcccttcagaatggacgtgttcaaggagaatggagtctacaagtttatcaccatcagatactgtgacctgaaggaaaccgtgaactcttacaccatcagcgagcacctgtacaaggccaagctaaaggccaaggacatcaagagcatggacagcttcaagtggtccttttacaagaacgacctgttggaatacaacggcgagctgtgtaccttcaaaggcgttaacgatgacaagaagaacaagattgaagtgaactgggtggaaaagaacttcgccatatacgccgagaagaaaaatctgaagtctaaacaactggtgaagtctatcaccaagagcaccgtgaagtccctgttaaagtacaccaccgacatcctgggaaacagataccccgtgcggaacgagaagctgaagctgatgatccggaagcagacctttagaggcgacctg

SEQ ID NO: 358 - DNA, 3270 bp, Artificial Sequence
  source: /note="Description of Artificial Sequence: Synthetic polynucleotide"
atgaacaatctgctctacagcttcgacatcggcactaacagcatcggctggtgcgtgttcgccctggatgaggttggcgacccttgtagaatcgttgacctgggcgcccggatctacgccgatggcagagatcctcaaaccaagacaagcctggccgtggccagaagagaagcacgggcgatgagccggcgacgggaccgaagcctgcggaggcgcaaggccacactgcggaccatgatcgagtacggcctgatgcctgcccacaaggtggaacaggagacactgctgcgcaaaaccggggacagagaaggaggagacgaagggttcaacccctacgccctgagagctagagccctgggcgagaagctgcctcctttttacatcggcagagccctcttccacctgggccagcggagaggcttcaagagcaaccggaaaaccgacagaaaagacaacgacaaaggaaaaatcgcacttggaatcgacgagctgagagccgctatgcacagatctggctcccctaccctgggcgcctggctggccatgagaagagcagacggccaccctgtgagactgagagccggcagcgaggtgttcgatgcagagggatacgctttttaccccgagagaagcctgctggaggacgaattcagacaaatctggaccgcccaggccgtgcatcacccacaactgctgaccagcgagcggcgggcccatctgttcagagtgatgttctaccagagacctctgaagaagcccctggtgggcagatgtagcttcaaccccgccgaggctagactgtctagagcccacccgctgtttcaggagttcagactctacaaagaagtgaatgacctggaggtggtgctgcccgaccagagccacagaaagctcaccctcgatgaaagaaacgccctggtagcaaagctgaagagttctagaaaggcctctttcagcgtgctgagacgaaccctcaagctgacccctgacctggccttcaacaaggaaagcgaggcccggaaggacctgctgggcgacgagattaacagcgccctggctgatgccaagatgtttggcgtgcggtggggcggctttcctagagcccggcagtgggaaatcatcacacacctgaaggaagaagaaaaccccgcccggttgagcgactggctgaaaagcgagttcggcctggacgacgagcgggtggtggctatcgccaatatcgccctcccagagggatacggccgtctcggcgaaacagccctggcatctatgctggaagaaatgaagaccgccgtcatccccgagagcgaagctgctaagcggtgcggctatgatcattctaatctggccaaggagcaggacgaggggctcgacatcctgcctgaatatcaggagatcctggaacggcatattcctcctggcaccggcgatcccgatgacatctacgacatccggaagggcagaattacaaaccctacagtccacatcggactgaaccaactgagaagagtggtcaacgccctgatcaagagacacggcaagcccaggcatatcgtggtggaactggccagagatctgcaactgagcgagaaacagaaggccgacgtgaacagacgcatcgccaaaaacacaagagaggccgagggcagatcccagaaactgatcgagatgggccaactggacaccggctacaaccggctgctgctgaagctgtgggaggaactgaatcaggacaagcctgaggacagagtgtgcatctattctgggaagcccatcggaatcgccatgctgttcagcggagaggtggatattgatcacatcctgccttggtccaagaccctggacgatagccaggccaacaagctgctgtgcctgaagtctgctaaccggcaaaagcggaacagaacccctagcgacgtgcctgagtggagagattgctacgaggaggtcctggctagagccgctaggctgcccaagaacaagcggtggcggttcgccgccgacgccatgcagcagttcgaggcagaaggcggcttcctggccagacaactgaccgacacccagtacctgtcaagaatggccttcgagtacctgagcgctctgttcccatctgaagaggccgataaatggggggagctaagacagcggaagagagtccacgtggtgcccggcagactgaccgagctgctgagaagaaactggggactgaacaccctgctgcctgaccacaacctgggcgagatggcccaggagaagaaccggaaagatcacagacaccacgccatcgacgccgccgtgatcggagtgacctccagatcgctgctgcagcggatgtctggagccgccgcaagacttgacgacgtggccttcgacgacctggtgcggaccgtggtgaaggacaatcctccttggcctggcttccgggaagaactgcttggttgtatcaacagagtcaccgtcagccacaagccagaccacggcaccgtgagcagagccgcctacgcacagggcaagggccaaacagccggcaaactgcacaacgacacagcttatggaatcaccggactgcaggacatgaagggcagcccactggtggtgcggagaaagcctttcatggccctggaagtgaaggacatcgcttctatcagagatactgagctgcaatctgccctgtacgacgccatcggatctctgacagagaagaaggccctgcaagaagccctggtgagattcagggacagacacccgcagtttaagggcatcagaagagtgcgggtgctggaagctctaagcgtgatccctatcgtggacaacaacggcaaggcctacaagggctacaagggcgatgctaattacagatacgaggtttgggagacactggatggcagatggcacaccgaagtggtgtccatgttcgacgcccaccagcctggctggcagagccccttccaccggcaacaccctgccgccagaagagtgctgaaactgcagcagaacgacatggtggcctacgaacacccggccgatggctacaccatcgctcgggtggttaagttctccaacgacaagagaatctacttcgcctcccacagagagagcggaagcctgaaggccagagacgccgacaagggggaccccttcacctactttgccaaggccaacaacggcctgagagacatcaagtgccggcaagtgaggatcgacgccgccggacgggtgttcgaccctggacctcaggatcgagaggccagacagtctaagggaagagcc

SEQ ID NO: 359 - DNA, 3324 bp, Artificial Sequence; identical to SEQ ID NO: 349
  source: /note="Description of Artificial Sequence: Synthetic polynucleotide"

SEQ ID NO: 360 - DNA, 3324 bp, Artificial Sequence
  source: /note="Description of Artificial Sequence: Synthetic polynucleotide"
atggccatcagatctatcaagctgaagctcaagaccagaacaggtcctgaggcccagaacctgcggaagggcatttggcggacacaccgcctcctcaacgagggcgtcgcctattatatgaaaatgctgctgctgttcagacaggagagcacaggcggccagaccaagaaagagctgcaggaagaactggtccggcacatcagagagcagcagcagaagaatcgggccgacaagaacacccaggccctgcctctggacaaggcttttgccgctctgcggcagctctacgagctgctggtgccttcttctatcggccagagcggagacgcgcagatcatcagcagaaagttcctgtcccctctcgtggaccccaacagcgagggcggcaagggcacatctaaagctggcgccaagcctacatggcagaaaaagaaggaggccaacgaccccacctgggaacaggattacgagaaatggaagaagcggagagaggaggaccctaccgccagcgtgattaccaccctggaagaatacggcatcagaccaatcttcccactgtacaccaacaccgtggccgacatcgcctggctgcctctgcagtccaaccagttcgtgcggacatgggacagagacatgctgcagcaggctatcgagagactgctgagctgggaaagctggaacaagagagtgcaagaggaatacagcaagctgcaagagaagatgacacagctcaacgagcaactggagggcggccaggagtggatcagcctgctggaacagtacgaggagcaacgggagcaggagctgatcgagaacatgaccgccgctaacgacaaatatagaataacaaagcggcagatgaagggctggaacgagctgtacgagcagtggagcaccgtgctgcccaatgcctctcacgagcagtaccgggaagcccttaagcgggtccagcaaagactgcggggcagattcggcgacgctcatttcttccagtatctgatgaaggaagagcaccacctgatttggaagggcaacccccagagaatccactactttgtggccagaaacgagctgaagaaaagactggaagaggccaagcagaacgccactatgaccctgccagacgccagaaagcaccccctgtgggtgcggttcgacgccagaggcggaaatctgcaggactactacctgaccgccgaggccgataaccccagatctagaagattcgttacctttagccagttgatctggcctaacgagtccggctggatggaaaagcaggacgtggaagtggaactcgccctgagcaagcagttctaccagcaagtgaccctgcagaagaacgataaggggaaacaggagatcgagtttaaggacaagggctccggatctacgttcagtggccatctgggcggggctaagctgcaactggagcgaggcgacctggagaaagaagagaaggactttgagggcggagaaatcggaagcgtgtacctgaacatcgtgatcgacttcgagcccttgcaggaggtgaaaaacggcagactgcagagcccatacggccaggtgctgcagctcgttcggagacctaatgagttccctaaggtgaccacatacaagtctgaagaacttgttgagtggatgaaggccagccagaatcacagcagcggcgtggagtctctggagtcgggcttcagagtgatgagcatcgatctgggactgaggacagccgctgccaccagcattttctctgtggaagaaagcaacgatgccaacgccgctggcttcagctactggatcgagggcacccctctggtcgccgtgcacaagagaagctacatgctgaagctgccaggcgaacaagtggaaaaacaggtgcgggaaaagagagatgagagacaagaccagcagaggcgcgtcagatttcagatcagaatcctgagccaggtgatcaggatggccaagaaacaaaacagagaaagagctgacgaactggaccacctgagccaggcactggagaagcagaagtccctgctcgatcagaccgatagaaccttctggaacggcatcgtttgtgacctgaccgatgcgctgcgcgaaaaggagggaggctgggagcaagccgtggtccaaatccacagaaaggccgaggaacacgtgggcaaggtggtgcaagcctggcggaaaagatttgacgccgatgagcggaagggcatcgccggcctgagcatgtggtccatagaagagctggacagcctccggaagctgctcattagctggagcagaaggacaagaaaccctcaggagatcaacagattcgagcagggccacacctctcaccagcggctgctgacacatatccagaacgtgaaggaagatagactgaagcaactgagccacgccatcgtgatgaccgccctgggctacgtgtacgacgagaagaagctggagtggttcgccaaataccccgcctgccaggtgatcctgttcgagaatctgtctcagtacagaagccacatggacagatccacgaaggaaaatagcaccctgatgaaatgggcccacagaagcatccctaagtacgtccacatgcaggccgagccttacggaatccagatcggagatgtgagagccgaatatagcagcaggttccacgccaagacagggacacctggcatccgttgcaagatggtgaagggacaagaactgcaaggcaagcgattcgagaacctgcaaaagagactggtgtccgaacagtttctgaccgaggaacaggtgaagcagcttcggcctggagatatcgtgccagatgacagcggagagtggttcatgaccctgagtgatggcagcgaaggcaaggaagtggtgttcctgcaagccgacatcaacgccgcccagaaccttcagaaacgattctggcagagatacaacgaactgttcaaggtgtcatgcagagtgctgatcagaggcgaggaagagtacctgatccccaaggccaagagcgtgcaagccaaactcggcaagggactgttcgtgaagaaaaccgacaccgtgatgaaggacgtgtacgtgtgggatagccaggccaaactgaagggcaaaacaaccttcaccgaggaaagcgagagccctgagcaactggaggacttccaggagatcatcgaagaagccgaggaagccaagggcacctacagaacactgtttagagatcctagcggcgttttcttccccgagttcgtgtggaatacccagaaagacttctggtccgaggtgaagagaaggctgtacggcaagctgcgcgagagattcctgatgaagacccgg

SEQ ID NO: 361 - DNA, 3336 bp, Artificial Sequence
  source: /note="Description of Artificial Sequence: Synthetic polynucleotide"
atggccattagatccatcaagctgaaaatgaagaccaactccggcaccgacagcatctacctgcggaaggccctgtggagaacacaccaactgatcaacgagggcatcgcctactacatgaacctgctgacactgtacagacaggaggctattggcgataagaccaaggaggcctaccaggctgaactgatcaacattatcagaaaccaacagagaaacaacggcagctctgaagagcacggctctgaccaggagatcctggccctgctcagacaactctacgagctgatcattcccagcagcatcggcgagagcggcgatgccaaccaactgggcaacaaattcctgtatcctttagttgaccccaacagccagagcggcaagggcacaagcaacgccggcagaaaacctagatggaagcggctgaaggaggaaggcaaccctgactgggagctggagaagaaaaaggacgaggaacggaaggctaaagacccaaccgtgaagatcttcgacaacctgaacaagtacggcctgctgcctctgttccccctgtttaccaacatccagaaggacatcgagtggctgcctctgggcaaacgccagagcgtgaggaagtgggacaaggatatgttcatccaggccatcgagcggctgctgagctgggaatcttggaatcggcgggtggccgatgagtacaagcaactgaaggaaaagaccgagagctactacaaggaacacctgaccggcggagaggagtggatcgaaaaaatccggaagttcgagaaggagagaaacatggaattagaaaagaacgccttcgcccctaacgacggatacttcatcaccagcagacagatcaggggctgggatagagtttacgagaagtggtccaagctgcccgagagcgccagcccagaagaactgtggaaggtagtggccgagcagcaaaacaagatgagcgagggattcggcgaccctaaggtgttcagcttcctggcaaaccgagaaaacagagatatctggagaggccactctgaacggatctaccacatcgccgcctacaacggcctgcagaagaaactgtccagaacaaaggaacaagccacattcaccctgcccgacgccatagaacatcctctgtggatcagatatgagtctccaggaggcaccaatctcaacttgttcaagctggaggaaaagcagaaaaagaactactacgtgaccctgagcaagatcatctggcctagcgaggagaaatggatcgaaaaggaaaatatcgagatccccctggcccctagcatccagtttaatagacagatcaagctgaaacagcacgtgaaaggtaagcaagagatctcatttagcgactacagcagccggatcagcctggatggagtgctgggaggctctagaatccagttcaaccggaaatacatcaagaaccacaaggaactgttaggagaaggcgatattggtcctgtgttcttcaacctggtggtggacgtggctcctctgcaggaaaccagaaatggcagactgcagtctcctatcggcaaggccctgaaggtgatctccagcgacttcagcaaggtgatcgactacaagcctaaggaactgatggactggatgaataccggcagcgcctctaatagtttcggcgtggccagcctgctggaaggcatgcgggtgatgtctatcgacatgggacagagaacctcagctagcgtgtctattttcgaggtcgtcaaggagctgcccaaggaccaggagcagaaactcttctacagcatcaacgacaccgaactgtttgccatccacaaaagatcctttctgctgaacctgcccggggaggtggtgacaaagaacaacaagcagcagcggcaagaaagaagaaagaagagacagttcgtgcggagccagatccggatgctggccaatgtgctgagactggaaacaaagaagacacctgacgagagaaagaaagccatccacaagctgatggaaatcgtgcaaagctacgatagctggacagccagccagaaagaggtgtgggaaaaggagctgaacctgctgaccaacatggctgccttcaatgacgagatctggaaggaaagtctggtcgaactgcaccacagaatcgagccttacgtgggccagatcgtcagcaagtggcggaagggcctgagcgagggcagaaagaacctggctggcatcagcatgtggaacattgatgaacttgaagatacaagaagactgcttatctcttggagcaagagatctcggacacctggcgaggccaatagaatcgagacagatgaacccttcggcagcagcctgctccaacacatccagaacgtgaaggacgatagactgaagcaaatggccaacctgatcatcatgaccgccctgggctttaagtacgataaggaagaaaaggaccggtacaagcggtggaaagagacataccccgcctgtcagatcatcctgttcgagaacctgaacagatacctgtttaacctggacagaagcagacgggagaacagccggctgatgaaatgggcccaccggtccattccaagaaccgtgtccatgcagggcgagatgttcggactgcaagtgggcgatgtgcggagcgagtatagctccagattccacgccaagaccggagccccaggcatcagatgccacgctctgacagaggaagatctgaaggccggcagcaacaccctgaagcggttgatcgaggatggcttcatcaacgaaagcgaattggcctatctgaagaagggcgacattatcccttctcaaggcggagaactgttcgtgaccctgtctaagagatacaagaaagacagcgacaacaacgagctgactgtgattcacgccgacatcaacgccgcccagaacctgcagaagcggttctggcagcagaacagcgaggtgtatagagtgccttgccaactggccagaatgggcgaagataagctctacatccctaagtctcagaccgagacgatcaagaagtactttggcaaaggcagcttcgtgaagaacaataccgagcaggaagtgtacaagtgggagaagagcgaaaagatgaagattaagacagacaccacctttgacctgcaagatctggacggcttcgaggacattagcaagaccatcgagctagctcaggagcaacagaagaagtacctgactatgttcagagacccttctggctacttcttcaacaacgagacatggcgcccccagaaggagtactggtccatcgtgaacaacatcatcaagtcctgcctgaagaagaagattctgagcaacaaggtggaactc

SEQ ID NO: 362 - DNA, 3324 bp, Artificial Sequence
  source: /note="Description of Artificial Sequence: Synthetic polynucleotide"
atggccatcagatctatcaagctgaagctcaagaccagaacaggtcctgaggcccagaacctgcggaagggcatttggcggacacaccgcctcctcaacgagggcgtcgcctattatatgaaaatgctgctgctgttcagacaggagagcacaggcggccagaccaagaaagagctgcaggaagaactggtccggcacatcagagagcagcagcagaagaatcgggccgacaagaacacccaggccctgcctctggacaaggcttttgccgctctgcggcagctctacgagctgctggtgccttcttctatcggccagagcggagacgcgcagatcatcagcagaaagttcctgtcccctctcgtggaccccaacagcgagggcggcaagggcacatctaaagctggcgccaagcctacatggcagaaaaagaaggaggccaacgaccccacctgggaacaggattacgagaaatggaagaagcggagagaggaggaccctaccgccagcgtgattaccaccctggaagaatacggcatcagaccaatcttcccactgtacaccaacaccgtggccgacatcgcctggctgcctctgcagtccaaccagttcgtgcggacatgggacagagacatgctgcagcaggctatcgagagactgctgagctgggaaagctggaacaagagagtgcaagaggaatacagcaagctgcaagagaagatgacacagctcaacgagcaactggagggcggccaggagtggatcagcctgctggaacagtacgaggagcaacgggagcaggagctgatcgagaacatgaccgccgctaacgacaaatatagaataacaaagcggcagatgaagggctggaacgagctgtacgagcagtggagcaccgtgctgcccaatgcctctcacgagcagtaccgggaagcccttaagcgggtccagcaaagactgcggggcagattcggcgacgctcatttcttccagtatctgatgaaggaagagcaccacctgatttggaagggcaacccccagagaatccactactttgtggccagaaacgagctgaagaaaagactggaagaggccaagcagaacgccactatgaccctgccagacgccagaaagcaccccctgtgggtgcggttcgacgccagaggcggaaatctgcaggactactacctgaccgccgaggccgataaccccagatctagaagattcgttacctttagccagttgatctggcctaacgagtccggctggatggaaaagcaggacgtggaagtggaactcgccctgagcaagcagttctaccagcaagtgaccctgcagaagaacgataaggggaaacaggagatcgagtttaaggacaagggctccggatctacgttcagtggccatctgggcggggctaagctgcaactggagcgaggcgacctggagaaagaagagaaggactttgagggcggagaaatcggaagcgtgtacctgaacatcgtgatcgacttcgagcccttgcaggaggtgaaaaacggcagactgcagagcccatacggccaggtgctgcagctcgttcggagacctaatgagttccctaaggtgaccacatacaagtctgaagaacttgttgagtggatgaaggccagccagaatcacagcagcggcgtggagtctctggagtcgggcttcagagtgatgagcatcgatctgggactgaggacagccgctgccaccagcattttctctgtggaagaaagcaacgatgccaacgccgctggcttcagctactggatcgagggcacccctctggtcgccgtgcacaagagaagctacatgctgaagctgccaggcgaacaagtggaaaaacaggtgcgggaaaagagagatgagagacaagaccagcagaggcgcgtcagatttcagatcagaatcctgagccaggtgatcaggatggccaagaaacaaaacagagaaagagctgacgaactggaccacctgagccaggcactggagaagcagaagtccctgctcgatcagaccgatagaaccttctggaacggcatcgtttgtgacctgaccgatgcgctgcgcgaaaaggagggaggctgggagcaagccgtggtccaaatccacagaaaggccgaggaacacgtgggcaaggtggtgcaagcctggcggaaaagatttgacgccgatgagcggaagggcatcgccggcctgagcatgtggtccatagaagagctggacagcctccggaagctgctcattagctggagcagaaggacaagaaaccctcaggagatcaacagattcgagcagggccacacctctcaccagcggctgctgacacatatccagaacgtgaaggaagatagactgaagcaactgagccacgccatcgtgatgaccgccctgggctacgtgtacgacgagaagaagctggagtggttcgccaaataccccgcctgccaggtgatcctgttcgagaatctgtctcagtacagaagccacatggacagatccacgaaggaaaatagccgcctgatgaaatgggcccacagaagcatccctaagtacgtccacatgcaggccgagccttacggaatccagatcggagatgtgagagccgaatatagcagcaggttccacgccaagacagggacacctggcatccgttgcaagatggtgaagggacaagaactgcaaggcaagcgattcgagaacctgcaaaagagactggtgtccgaacagtttctgaccgaggaacaggtgaagcagcttcggcctggagatatcgtgccagatgacagcggagagtggttcatgaccctgagtgatggcagcgaaggcaaggaagtggtgttcctgcaagccgacatcaacgccgcccagaaccttcagaaacgattctggcagagatacaacgaactgttcaaggtgtcatgcagagtgctgatcagaggcgaggaagagtacctgatccccaaggccaagagcgtgcaagccaaactcggcaagggactgttcgtgaagaaaaccgacaccgtgatgaaggacgtgtacgtgtgggatagccaggccaaactgaagggcaaaacaaccttcaccgaggaaagcgagagccctgagcaactggaggacttccaggagatcatcgaagaagccgaggaagccaagggcacctacagaacactgtttagagatcctagcggcgttttcttccccgagttcgtgtggaatacccagaaagacttctggtccgaggtgaagagaaggctgtacggcaagctgcgcgagagattcctgatgaagacccgg

SEQ ID NO: 363 - DNA, 21 bp, Artificial Sequence
  source: /note="Description of Artificial Sequence: Synthetic oligonucleotide"
cccagccctaggttgtttatt

SEQ ID NO: 364 - DNA, 23 bp, Artificial Sequence
  source: /note="Description of Artificial Sequence: Synthetic oligonucleotide"
ctggctacatcttccttgactac

SEQ ID NO: 365 - DNA, 20 bp, Artificial Sequence
  source: /note="Description of Artificial Sequence: Synthetic oligonucleotide"
gagctgcacatttgacgagc

SEQ ID NO: 366 - DNA, 20 bp, Artificial Sequence
  source: /note="Description of Artificial Sequence: Synthetic oligonucleotide"
attacaggtgtgagccacgg

SEQ ID NO: 367 - DNA, 20 bp, Artificial Sequence
  source: /note="Description of Artificial Sequence: Synthetic oligonucleotide"
accagaacatgcctgatggg

SEQ ID NO: 368 - DNA, 20 bp, Artificial Sequence
  source: /note="Description of Artificial Sequence: Synthetic oligonucleotide"
gcccctcaatcatctctggg

SEQ ID NO: 369 - DNA, 20 bp, Artificial Sequence
  source: /note="Description of Artificial Sequence: Synthetic oligonucleotide"
cccaccctttgagagtgcat

SEQ ID NO: 370 - DNA, 20 bp, Artificial Sequence
  source: /note="Description of Artificial Sequence: Synthetic oligonucleotide"
gattgaagggcagagggagg

SEQ ID NO: 371 - DNA, 25 bp, Artificial Sequence
  source: /note="Description of Artificial Sequence: Synthetic oligonucleotide"
gagatgtccccagtgaactccaaat

SEQ ID NO: 372 - DNA, 25 bp, Artificial Sequence
  source: /note="Description of Artificial Sequence: Synthetic oligonucleotide"
cctgtcgttgcccctcccagatcat

SEQ ID NO: 373 - DNA, 49 bp, Artificial Sequence
  source: /note="Description of Artificial Sequence: Synthetic oligonucleotide"
gtctgattgcctgtcgttgcccctcccagatcatggaggagttggcaga

SEQ ID NO: 374 - protein, 192 aa, Artificial Sequence
  source: /note="Description of Artificial Sequence: Synthetic polypeptide"
MEPWRPSPRNPMDRIDPNTFRFHFPNLLYASGRKLCYLCFQVETGDYFSCDDSDRGVFRNKVHPWARCHAEQCFLSWFRDQYPCRDEYYNVTWFLSWSPCPTCAEEVVEFLEEYRNLTLSIFTSRLYYFYHPNYQQGLRKLWDAGVQLDIMSCDDFEHCWDNFVDHKGMRFQRRNLLKDYDFLAAELQEILR

SEQ ID NO: 375 - protein, 398 aa, Artificial Sequence
  source: /note="Description of Artificial Sequence: Synthetic polypeptide"
MQEKEVLNSLRCNTQSIEEEIQINTLLNKTKRNRIKINNLDEFKDVLKKEGYEINEFDEEKFKEDLVKIFQVDNGVIENLHTYINNPEISYKVYDTSDLIDYIKKMILFENEYNRLCKKISSVKKLDIDRVEYEREFSLQDNVEDIIKAIEEIKDDISGIISKEGKTRLENLEREINKEYLYAKDIELLKKMVIIENENVKEKYNIESKIKTISIKIPKKINYEHIVAKKGSVEYHDYLSSNIPRMQRLIKNIHKYMKVDEKEKSTFKINQSKALQDSINIAVATYDNKEFKAISGSNDIKNYCRRTPLENATFKSSKVNKLGNLGIGYNRVNDSEKKIFEEIHRQIEKNTLKDEGNLILYTKLEPCPSCYYVISQFCKKHPNIKVQIKYSEKYGEWR

SEQ ID NO: 376 - protein, 201 aa, Artificial Sequence
  source: /note="Description of Artificial Sequence: Synthetic polypeptide"
MEEKKLALVSKIHYELEDKGIELRNLALIHKDRTELLARIKAKSRKRPIYFYRYLEDLPEFLGGNDAVLEYIPNGDNTNKKIYFANSFVNYTDSPFSDIYIEFTDSVYVLIPEDKKFDAIITNRDREIGNGHLRENDTEYKLMVEISDKIDTTVPGHINIYTYYEPCLSCDNVFIQFSKKFPNVSVNVYFSDEYKSKKWVV

SEQ ID NO: 377 - protein, 237 aa, Artificial Sequence
  source: /note="Description of Artificial Sequence: Synthetic polypeptide"
MSLLTAETFSLQFNNRRQRRKKGTYYPKRTYLCYQLTPRNGSTPTRGYFKNKKNCHVEICFIDKIASMELDKTQCYDVTCYLTWSPCPSCAQKLAAFAKAQDHLNLRIFASRLYYHWRRSYQKGLQLLWESQIPVEVMGLPEFTDCWENFVDHGKPPPFNPSEKLQKLGEASQSIKRRLERIKVRRCPAAAHCLLTARLGPTPDHASAHCSSPYFFFLLYLFYSIHPIIKYHRLGDS

SEQ ID NO: 378 - protein, 197 aa, Artificial Sequence
  source: /note="Description of Artificial Sequence: Synthetic polypeptide"
MAAVTNRDSACRENNQRWKIQPNDFRRNYLPDKQPRVVYLLYEIRWRRGTIWRNWCSNNPNQHAEVNFLKNYFNAMPSVSCSITWVLSTTPCGKCSIKIMEFLKLHPNVTLEIYAAKLFKHLDIRNREGLRNLAKNGVIIHIMNLADYSYWWKIFVTRQHGEEDYLPWSFALHIFLNCIEFQQILLGLPPLLPNFKY

SEQ ID NO: 379 - protein, 333 aa, Artificial Sequence
  source: /note="Description of Artificial Sequence: Synthetic polypeptide"
MPCVLGLCKHLSETSAVHCPALLIALRQAVERLLAPLLQDPLYITATTLDPQFKLSWSNNTDCLQTVMADRSRIGAKKKEKSDEKALDKDKTKEKNAKKPDKVVKKSEKLPEKTLEKTSEQSKADEESRTTEAEGATGSTNEENGEFQPIELPPFEIVKGEQMSPFYFKFQFRNVEYSSGRNKTLLCYRVDTAGGSTEPLKGYMEDEHTTAHAEEAFFQQVLPDSSQHHDVTWYVSSSPCADCAAKLASILCQRKNLKLCVFCSRLFEWEEPEIVEGLRALVTAGCKLRMMKPSDFMHVWETYVDKEEQNFSPWEDCQDNYNYYVEKLAEILK

SEQ ID NO: 380 - protein, 207 aa, Artificial Sequence
  source: /note="Description of Artificial Sequence: Synthetic polypeptide"
MAFGNFSNWINEGVDEIQFTKELYEKLLKHSEQEAISYLFKLSSLEHFNQWKFYLILLQTLTSKCSDENGAFIRKYLKTRLTQIAALPKREYMLHLLLSVRAATATTMDIDKNITAYADWYKRNVADMKFVLKVEEFKAIIDLLEQCIPYESLEDYLEIHATFSISPPIHCGKLVQSYKSKCKMQLAKIKSKVKQGNEHEESIVIDD

SEQ ID NO: 381 - protein, 383 aa, Artificial Sequence
  source: /note="Description of Artificial Sequence: Synthetic polypeptide"
MTQTEIKIGRKKLRINIKTIDELEKAMKNEGYNVASFENLNVEEFKSEICNLVNIKPNVAEHIYFNMSQCEREISYRSNNVQDFLDYMEKITEIKEYEKILWKKIRKVDKIHIDRIEYDRKPSIQEDVEHMINAIKNVKNTMCGKIDEYEKLRLYELETGIDENYIYAKDIELLKKMIIKDKGKVKNTYDEFTCNKRIYIDIPENMNSSYIKPLEGSIEYHEHISRNIPRIKRLIKNLDKYMKITSDEEGNKVCEINQSKALQDSINIAVAVYNQKEFKAVSGSDEVDDYCMAMEKEETVFESCRVNRLGKIGIGYNRFYDSEKKILEEIHKQIEEKKLDDRGNLVMYSRWEPCPSCYYVISQFCSAHPQIEVSVKFDKSYGE

SEQ ID NO: 382 - protein, 197 aa, Artificial Sequence
  source: /note="Description of Artificial Sequence: Synthetic polypeptide"
MVTRVRKFHYSEDTNGQVLRRISKQYKKRINLTARRKEKNDQDYSFEYRMSYPRFEGGNDAVLEYVRPGRTTKVERFLYYANSAVNDRYSPFAMLGGRRGQYTLIPAEPKFSHFRTTRKREVNMGTLRENDTEYKLLERVTQDILSQDERGLIRMYTYYEPCLSCDYVMIQFINMYPNIKIDVYYEEDYKPEEKGLI

SEQ ID NO: 383 - protein, 373 aa, Artificial Sequence
  source: /note="Description of Artificial Sequence: Synthetic polypeptide"
MIENPALKISKRDRIKISNLKDLKNALKNENYNIKANDKEKFKDEVKKVFNINDDIFERLDKCLNRDITYKVDNVEDFIDYIKKIMIFEDKHEIICEKLKRIKKLYINREEYEREKSTRDNVEHIIEVIEKTKENVSRKISLEELERLEILEEELEDKYLFAKDIEFLKKMILGNCKNVIESYNEKTKIKTLKMKIPKEINYSYIKAKEGSVEYHQYLNNNINRMNRLIKSIDKYIEHYKDDIFNINQSLALQDSINIALATFDNKEFKAISGKNDIEDYCKVIPIEKSRFKSRKVNKLGELGIGYNRINDSEKKILEEIHEKIKQKILKDRGNLTLYTKWEPCPSCYFVISQFCEKYPNIKVEVKYNKKYGE

SEQ ID NO: 384 - protein, 330 aa, Artificial Sequence
  source: /note="Description of Artificial Sequence: Synthetic polypeptide"
MRRKKPSGMYISKRALKDNFDPHKFPHDTYLLCKLQWGDTGRSWIHWIRKDRYHAEVYFLEKIFKMRRSKNYVNCSITWYLSWSPCVRCCCEILNFLEKHSYVNIDIYVARLYKIQNSEVREGLKKLVSSKKVTIAVMEIKDYTYCWKNFIQGDADDDSWTVDFQSAITKNRLKLKDVFEFLKSHPNVTLEIYAAKLFKHLDIRNREGLRNLAKNGVIIHIMNLADYSYWWKIFVTRQHGEDDYLPWSFALHIFLNCIEFQQILLVSRHLKESLRVKSNEKAQEKEVWRIPAMVLAEMIVGKMNRDLMLHEQRANRARNCKGLWCYIVPL

SEQ ID NO: 385 - protein, 195 aa, Artificial Sequence
  source: /note="Description of Artificial Sequence: Synthetic polypeptide"
MSNVRKYHYSVNSVGEELKKLVEYHKRRTEMYARIKAKNNPSAYRNYLNELPGFEGGNDAILIFQVNGNHKSRIRRCANSFVNDSTSSFANIPVNFTGKYVLIPHPPAQKFSYICTNKHREIGVGHYRNNDTEYKLLEDISRRITPTLVGHINLFTFYEPCLSCDYVIIQFANKYPLITIDVYFEEEYRPENGVI

SEQ ID NO: 386 - protein, 202 aa, Artificial Sequence
  source: /note="Description of Artificial Sequence: Synthetic polypeptide"
MVAIVRKMHYEDNKEGIRLQRRSRQYKHAMLQMADRKATMDSVYQKVMNLSVLRFTGGNDAVLEYSICIDPDRNKKLKKPVSRYHANSAVNDMNSPFAKIMGNRIRYTLIPQKSTFIHFHTNRNREINNGTPRENDTEYKLLEKVKEDIHDRYQEGLIRMYTYYEPCLSCDYVIIQFTERYPNIDIEIYYEEEYKPQEKGLI

SEQ ID NO: 387 - protein, 365 aa, Artificial Sequence
  source: /note="Description of Artificial Sequence: Synthetic polypeptide"
MNPQIRNPMERMYRRTFYYNFENKPILCGRSYTWLCYEVKIRKDPSKLPWDKGVFRGQVLPKFQSNHRQEVYFQLENHAEMCFLSWFCGNQLPANRRFQITWFVSWNPCLPCVAKVTEFLAEHPNVTLTISAARLYYYRGRDWRRALRRLHKAGARVKIMDYEDFAYCWENFVCNEGQPFKPWYKFNDNYAFLHHRLNEILRNPMEVTYPHIFYFHFENLRKAYGRNETWLCFTMKVIKWPSRVSWKSGVFRNQVAPKPHCHAEMCFLSCPCPECAGEVAEFLARHSNVNLTIFTARLYYFWNTDYQEGLRSLSEEGASVEIMEYKHFKYCWENFVYNDDEPFKPWKGLKTNFRFLERKLWEIIK

SEQ ID NO: 388 - protein, 204 aa, Artificial Sequence
  source: /note="Description of Artificial Sequence: Synthetic polypeptide"
MVAKKTKVTKFHYKSNEHGIELHKMCKAQNEWVLKMAKGRSERNLMYNVKYHLAFPRFKGGNNAVLVHLEYVGKDKNKTRPRAVFHASSAVDDSDSPFARVGGGSRRKYALIPSKPMFKPIRTNRNRDINHGHFRENDTEYKLLEKVSQYIDDKDEHSLIRMYTDLEPCLSCDYVIIQFTKRYPNINIEVYYKDEYKPKGEGLI

SEQ ID NO: 389 - protein, 242 aa, Artificial Sequence
  source: /note="Description of Artificial Sequence: Synthetic polypeptide"
MNPLQEVIFCRQFGNQHRVPKPYYRRKTYLCYQLKLPEGTLIHKDCLRNKKKRHAEMCFIDKIKALTRDTSQRFEIICYITWSPCPFCAEELVAFVKDNPHLSLRIFASRLYVHWRWKYQQGLRHLHASGIPVAVMSLPEFEDCWRNFVDHQDRSFQPWPNLDQYSKSIKRRLGKILTVRSCPCCRHLASLPLGLPFPAHRPLLSVLALCPQCPSTPFSFLETPVPPVGAPRLPLPSLAPFS

SEQ ID NO: 390 - protein, 486 aa, Artificial Sequence
  source: /note="Description of Artificial Sequence: Synthetic polypeptide"
MNPQIRNPMERMYRPTFYYNFENEPILCRRSYTWLCYEVKIRKDPSKLPWDTGVFRGQMYFQPEYHAEMCFLSWFCGNQLPAYKRFQITWFVSWTPCPDCVAKVAVFLAEHPNVTLTISAARLYYYWEKDWQRALCRLSQAGARVKIMDYEEFEYCWENFVYNEGEPFMPWYKFDDNYAFPHRFDANYAFLHHTLKEILRHLMDPDTFTFNFNNDPLVFGRHQTYLCYEVERLDNGTWVKMDQHRGFLHNQAKDPLYGFDGRHTELCFLGLIPYWQLDLAQTYRVTWFISWSPCFSWGCAEQVRAFLQENTHMRLRIFAARIYDYDPLYKEALQMLRGAGAQVSIMTYDEFEHCWDTFVDHQGRPFQPWDGLEEHSQALSGRLQAILLVRASSLCPVPHRPPPPPLSPGPCLPLCSEPPLGSLLPTGCPAPSLPFLLTASLSPASRLLPVPSFHSLTSCSIQPSCSSIIRETEGWASVSKEGRDLV

SEQ ID NO: 391 - protein, 174 aa, Artificial Sequence
  source: /note="Description of Artificial Sequence: Synthetic polypeptide"
MEASPASGPRHLMDPHIFTSNFNNGIGRHKTYLCYEVERLDNGTSVKMDQHRGFLHNQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 392 - protein, 189 aa, Artificial Sequence
  source: /note="Description of Artificial Sequence: Synthetic polypeptide"
MAEKQEEPSNAQNGEPDNAEEGEGKKKKVKREDLPPFEIVTGERLPAIFFKFQFRNVEYSSGRNKTFLCYVVETQGKEAATSRGYLEDEHAAAHAEMAFFNSILPKCQAGARHDVTWLFMWEEPEMQAALRGMKEAGCKLRIMKPQDFEYVWKNFVEPEEGEEAKSFVPWEDIQENFQYYEEKLAEILH

SEQ ID NO: 393 - protein, 420 aa, Artificial Sequence
  source: /note="Description of Artificial Sequence: Synthetic polypeptide"
MEPQHPRQRAGMGLASKGGCSQRPRIRNPVEWLDHQTFSFHFRNLRFASGRNCTYLCYQVERLKHFSPDSSDWGVFQNRVYPETPCHAELCFLSWFRTKKLSPYEQYRITWFLSWSPCLPCAEQVAAFLKENRNVRLSIFAARLYYFWKPDCQQGLRALHQQRAWVRIMSFRDFKYCWKNFVYNQGMPFKPWKKLRKNYQFLVAKLHEILGNTMNLLKKHIFRQQFGNQHRVPQPYYRRKTYLCYQLKQLDGFTLDKGCFQNKKQRHAEIRFIDKITSLNLDPNQSYKIICYVTWSPCPTCAKELVDFINGQDHLSLQIFASRLYFHWVKVFQRGLQQLQAAQVSVAVMTRSEFEDCWEEFVDNQGMPFESWDKLEQYSESISRRLQKILSPSNWNNLEDSFRDLRLGSPSPSSLRSDSR

SEQ ID NO: 394 - protein, 252 aa, Artificial Sequence
  source: /note="Description of Artificial Sequence: Synthetic polypeptide"
MEDNAAPEPRPLLDQGTFMDHFANEDGGRGLNETYLCYEVQLLDGSSQHQGFLRNKNFCIDFDPSLRRHAELCFLDLVPAWRLDPAQHYRVTWFISWSPCFLCAQAVAEFLRRNAHVSLRIFAARIYTWRTDYKAGLQDLQRAGAQIAIMTPAEIQFCWNTFVDNQSNPFHSHLGLGHAKPAPAEGAAEHPPGSLNRAGALPGASRKKFCIRERRPRTPRTPRTPRRQPSPAVRRRPRRDWSDALRVGMRRF

SEQ ID NO: 395 - protein, 413 aa, Artificial Sequence
  source: /note="Description of Artificial Sequence: Synthetic polypeptide"
MAGLGQACEGCCGQMPEISYPMGRLDPKTFSFEFKNLLYAYRRKSSYLCFQVEREQHSSPVPSDWGVFENQFYHAELRFLNWFRAEKLSPYEHYDVTWFLSWSPCSTCAKKIAIFLSNHKNVRLSIFVSRIYYFWKPAFRQGLQELDHLGVQLDAMSFHDFKYCWENFVDNQGMPFRCWKKVHRNYKFVLRKLNEILRNMNLLSEKTFNYHFGNQLRVKKPQGRRRTYLCYKLKLPNETFDKGYFINKKKNHAEIRFINKIRSLNLDQTQSYKITCYITWSPCSYCAGKLVALVKSCPHLSLQIFTSRLYYHWLWKNQAGLRYLWKINIPVLVMKEPDFADCWDNFVNHQSRRFKPWEKLTQYSNSTERRLLRILRINRTDLFLAQSSEQDPGLNDLVDAIKRLFLDAHRPRD

SEQ ID NO: 396 - protein, 120 aa, Artificial Sequence
  source: /note="Description of Artificial Sequence: Synthetic polypeptide"
MAGLGHACEGCCGQMPEISYPMEGLDPETFFFEFQNLLYAYGRKSSYLCFQVEREQHSSPVPSDCGVFKNQVWAPLLSKAGAKPVEDAEKNITCKMPSASSHNNVQCPGPLMSLPDPPAS

SEQ ID NO: 397 - protein, 235 aa, Artificial Sequence
  source: /note="Description of Artificial Sequence: Synthetic polypeptide"
MNSKTGPSVGDATLRRRIKPWEFVAFFNPQELRKETCLLYEIKWGNQNIWRHSNQNTSQHAEINFMEKFTAERHFNSSVRCSITWFLSWSPCWECSKAIRKFLDHYPNVTLAIFISRLYWHMDQQHRQGLKELVHSGVTIQIMSYSEYHYCWRNFVDYPQGEEDYWPKYPYLWIMLYVLELHCIILGLPPCLKISGSHSNQLALFSLDLQDCHYQKIPYNVLVATGLVQPFVTWR

SEQ ID NO: 398 - protein, 378 aa, Artificial Sequence
  source: /note="Description of Artificial Sequence: Synthetic polypeptide"
MTQENTQLKKKIKKERIRINNLSDFRAALKKEGYNINGLEEEKFIDKIIDILKLDRSVAKKIFASFKDTAVTYRANDIMDFIDYMKKISLFENEHNKLCEKIRKIEKLSIARVEYERELKVKDDVEHIITRIEEIKSDISEIANHEEKEKLYSLEKEIEKEYLYAKDIELLKKMLITRKECSREKYNEETKIKVVSIEIPKDIDYRYIPAQIGTIEYHQHLSNNIPRMQRLTKNINKYMRVHENEKTTFKINQSKALQDSINIALATYDNKEFKAISGSNNIVDYCVAPKEEEAVFKSNKVNKLGELGIGYNRVNDSEKKILEEIHKQIEEKTLKDEGDLILLSKWEPCPSCYFVISQFCKMHPQIKVQVKYSKKYGE

SEQ ID NO: 399 - protein, 201 aa, Artificial Sequence
  source: /note="Description of Artificial Sequence: Synthetic polypeptide"
MEASPASRPRPLMDPHMFTGNFTNNPRVFGLHQTYLCYEVKRQGPDGTRDLMNEQRDFLCNQAKNHFSGSEDHHAERCFLDRIPSWQLDPAQTYRVTCFISWSPCFSCAQEVAEFLHENPHVNLRIFAARIYDYLPRYEEGLQMLQNAGAQVSIMTSEEFGHCWDTFVDRQGHPFQPWEGLDEHSQALSGRLQAILQNQGN

SEQ ID NO: 400 - protein, 137 aa, Artificial Sequence
  source: /note="Description of Artificial Sequence: Synthetic polypeptide"
MHLQVWRKVTEAWREGYTLKPWSRNPMERLYHDYFYFHFYNLPTPKHRNGCYICYQVEGTKNHSRMPLLRGVFENQGLRKLHDAGVHVAIMSYYEFKHCLNDFVFHQGRSFCPWNDLNKNSKNLSNTLEDILQDQED

SEQ ID NO: 401 - protein, 381 aa, Artificial Sequence
  source: /note="Description of Artificial Sequence: Synthetic polypeptide"
MKPQTRNTVVRMDPDTFFYNFYNRPILSHRNTVWLCYEVKMKTNDPSRPPLVANIFQGQVSFNPEHHAEMYFLSWFRGNLLPACKRSQITWFVSWNPCLYCVAKVAEFLAEHPKVTLTVSTARLYCYRKKDWRRALRKLSQTGARVKIMDYEEFQHCWDNFVDNQREPFEPWNALPKHYTLLRITLGEVLRHRMDPVTFTYNFTNDPSVLGQHQSYLCYKVEHLRNGTWVPLHQHRGFILNEASNSVSFPEGRHAELCLLDLISFWKLKQAQRYRVTCFISWSPCFSCAEKVAEFLQENPHVNLHISAARIYDYQRGYKKGLRRLDRAGTPISMMKYSEFKHCWDTFVDHQGHPFQPWEELNEHSQALSGRLQAILQNQGN

SEQ ID NO: 402 - protein, 184 aa, Artificial Sequence
  source: /note="Description of Artificial Sequence: Synthetic polypeptide"
MYRRKMRGMYISKRALRKHFDPRNYPRETYLLCELQWRGSHKSWQHWLRNDDSKDCHAEKYFLEEIFEPRSYNICDMTWYLSWSPCGECCDIIQDFLEEQPNVNINIRIARLYYADRASNRRGLMELANSPGVSIEIMDADDYNDCWETFIQPGVYYRFSPENFESAIRRNCSQLEDILQGLHL

SEQ ID NO: 403 - protein, 218 aa, Artificial Sequence
  source: /note="Description of Artificial Sequence: Synthetic polypeptide"
MHLQVWRKVTEAWREGYTLKPWSRNPMERLYHDYFYFHFYNLPTPKHRNGCYICYQVEGTKNHSRMPLLRGVFENQFFSKKRRHTELCFLSWFRTEKASLDMLLSSGEKYRVTWYISWSPCFACVDEVVKFLREHKNVELIIFAARLYHSDILQYRQGLRKLHDAGVHVAIMSYYEFKHCLNDFVFHQGRSFCPWNDLNKNSKNLSNTLEDILQDQED

SEQ ID NO: 404 - protein, 338 aa, Artificial Sequence
  source: /note="Description of Artificial Sequence: Synthetic polypeptide"
MASDKGPSAGDATLRRRIKPWEFEVFFDPRELRKETCLLYEIQWGTSHKIWRNSGKNTANHVEINFIEKFTSERQYCPSIRCSITWFLSWSPCWECSKAIRGFLSQHPSVTLVIYVARLFWHMDPQNRQGLRDLINSGVTIQIMRVPEYDHCWRNFVNYLPGKEDHWPRYPVLWMKLYALELHCIILPIEMPGKIRDAPNNMEIFSLFVGRYIPKTKFHVTCLLSDVRNDDSHLDKTAPKWIRFDSLQPVASDPSAEHWKMKLPGRDDKTAVVVGTVTEDVACAQGAKLYLCALRVHGHAQRHFLKGRDEILALDQLALDSPQGLWRQPDLRSHPLKG

SEQ ID NO: 405 - protein, 207 aa, Artificial Sequence
  source: /note="Description of Artificial Sequence: Synthetic polypeptide"
MQKFTDFLGGIQLGLVRKYHYSVDGVGVALRDLIYIHKERLEKKARRRAKSSNKMFFEYITDFLEFEGGNDAILEYIPNGNNKAKRIFCANSFVNDKTSPFANIRMPYTGQYALIPPKHAQKFNYIITNRERELGKGHRRANDTEYKLLELIASRISPVDVGHINLYTYYEPCLSCDYVIVQFVKKYPNISINVYFEEEYRPEKGVI

SEQ ID NO: 406 - protein, 194 aa, Artificial Sequence
  source: /note="Description of Artificial Sequence: Synthetic polypeptide"
MKKVKGVSKMHYEQSIDGINLRVKSDKMKERVRKNTWIRVKKGIISKREFQEALPFFNSGNDAVLQYTPLGEKIEKKKLFYANSSVSDFKNPFAYLRKYALMPLEKDQNFNWIHTNRKREIHTGTPRNVDTEFKLLEKLAKYIDSGDVGTIDLYTYYEPCLSCDYVIIQFTKKYPNIKVNVYFSEEYKPKKGMI

SEQ ID NO: 407 - protein, 262 aa, Artificial Sequence
  source: /note="Description of Artificial Sequence: Synthetic polypeptide"
MHHSARLPPNCIVSRYANAPWTVLPLPLPPTEAPATGDDTLRRRIEPWEFEAFFNPQELRREACLLYQITWSSHKVWRETAKNTVDSHVEVNFIQNLTAGRYCRPSTRCSILWFLSWSPCSSCSKAIRLFLSQHPGVSLVIYVARLFQHMDPQNRQGLRELIHSGVTIQVMRPQEYDYCWKNFVNYPPGQEEHWPRYPVQCMTLYNLELYCIIHNLPPCVRISKQRQSQLAFFSLGLENVHYQRIPPPLLLLTGLVFVFPWK

SEQ ID NO: 408 - protein, 395 aa, Artificial Sequence
  source: /note="Description of Artificial Sequence: Synthetic polypeptide"
MNPQIRNPMEGMDRHAFNYNFENEPILYGRSYTWLCYEVKIRKDPSKLPWDTGVFRGQVRPKLQSNRRYELSNWECRKHVYFQPQYHAEMCFLSWFCGNQLPAHKRFQITWFVSWTPCPDCVAKVTEFLAEHPNVTLTISVARLYYYRGKDWRRALCRLHQAGARVKIMDYEEFAYCWENFVYNEGQSFMPWDKFDDNYAFLHHKLKEILRNPMEATYPHIFYFHFKNLRKAYGRNETWLCFTMEIIKQHSTVFWETGVFRNQVYPESLCHAERCFLSWFCEDILSPNTDYRVTWYTSWSPCLDCAGEVAEFLARHSNVKLAIFAARLYYFWDPHYQQGLRSLSEKGASVEIMGYKDFKYCWENFVYNGDEPFKPWKGLKYNFLFLDSKLQEILQ

SEQ ID NO: 409 - protein, 191 aa, Artificial Sequence
  source: /note="Description of Artificial Sequence: Synthetic polypeptide"
MNPLQEETFYQQFSNQRVPKPTYQRRTYLCYQLKPHEGSVIAKVCLQNQEKRHAEICFIDDIKSRQLDPSQKFEITCYVTWSPCPTCAKKLIAFVNDHPHISLRLFASRLYFHWRQKYKRELRHLQKSGIPLAVMSYLEFKDCWEKFVDHKGRPFQPWNKLKQYSESIGRRLQRILQPLNNLENDFRNLRL

SEQ ID NO: 410 - protein, 198 aa, Artificial Sequence
  source: /note="Description of Artificial Sequence: Synthetic polypeptide"
MAVEEEKGLLGTSQGWKIELKDFQENYMPSTWPKVTHLLYEIRWGKGSKVWRNWCSNTLTQHAEVNCLENAFGKLQFNPPVPCHITWFLSWSPCCQCCRRILQFLRAHSHITLVIKAAQLFKHMDERNRQGLRDLVQSGVHVQVMDLPDYRYCWRTFVSHPHEGEGDFWPWFFPLWITFYTLELQHILLQQHALSYNL

SEQ ID NO: 411 - protein, 234 aa, Artificial Sequence
  source: /note="Description of Artificial Sequence: Synthetic polypeptide"
MDPQRLRQWPGPGPASRGGYGQRPRIRNPEEWFHELSPRTFSFHFRNLRFASGRNRSYICCQVEGKNCFFQGIFQNQKKRHAEIRFIDKINSLNLDQNQCYRIICYVTWSPCHNCAKELVDFISNRHHLSLQLFASRLYFHWVRCYQRGLQRLQANRVSVAVMKGPEFKDCWEKFVDHQGESFPSWEKLEQYSESISRRLSRILRFANQNNLEDSFRDLRLGSPSPSSSRSDSR

SEQ ID NO: 412 - protein, 377 aa, Artificial Sequence
  source: /note="Description of Artificial Sequence: Synthetic polypeptide"
MTKINIISNKRKKERIKINNLNDFKDALKKEGYKINYFDEEKFKIEVAKAFKVENSLIEELYKCIGEEQATYRADDVSDLINYMKKIILFEYEHDRLWKKINSIKILNINRIEYERDTVSRDDVKDMLIDIKEVKKRVSRIVSEKEKEKLEILEKELDNDYLYSKDIELLKKMLLIKKERVKESYNINTKVKTISIEIPKQIDYHYITPQKGTVEYHQHLSNNIPRMQRLIKNINKYMKADEEERSIFKINQSKTLQDSINIAVAIYDNKEFKAISGSNNIKDYCHAPTKDESFFKSNKVNKLGEFGIGYDRINDSEKKIIEEIHKQIEAKVLKDEGNLTLYSKWEPCPSCCFVISQFCKKHPNIEVQVKYHKKYGE

SEQ ID NO: 413 - protein, 356 aa, Artificial Sequence
  source: /note="Description of Artificial Sequence: Synthetic polypeptide"
MGPVRVCESAVIWAAGTSKAGEPLSWPSTPPGGAGYQRPSLAACTGTRLLTYILREETQHGVPSFSARRAPGSLRQATAVLAAAGDSAMGRHGACPPGCLLDENTFAENYMNQISTRKTYLCYKVEILGGDARVPPDESKGFVQNKGANEPGWPRHAELYFLDRIRSWNLDPGLRYRLTCFISWTPCHTCAQELATFLGENSHLSLHIFASRIYSLPGYEAGLRTLQAAGAQIAIMTSQEFEHCWKNFVDHQGRTFEPWDELEVVSQHLCKKLQEILQALCVLQEGAHGRLADNEAAFSGAAKLRLSRGGLEPGAWQGANWRGSPRLWYLSLAGPAGPGTAASALPVAPGAASHYR

SEQ ID NO: 414 - protein, 211 aa, Artificial Sequence
  source: /note="Description of Artificial Sequence: Synthetic polypeptide"
MEDFHCVCVYCPLQVSVMSDYQAASSSPDCPQCPQHILTGAEAAVSYSQFCETFGFHMGPSGARALLLFYELWGPSGTLVQRGQASNLLEVCEEVLYSNYMPCQECSQTLISFLLRYPWVRLDLLFSQLYHTAPSQTHSLDNQTGLRSLAVLTLSPNSGAAWGHLLRCFVRDVPPSALQLPLLPERVEADRVNAIHISATTGIGPAFWTSH

SEQ ID NO: 415 - protein, 230 aa, Artificial Sequence
  source: /note="Description of Artificial Sequence: Synthetic polypeptide"
MTGAIWNFVHSALMNFLNAMALLTAETFSLQFNNKRCVSKPYYPRKALLCYQLTRQNGSTPTRGYLKNKKKHHAEIRFIKKIESMGLDKTQCYQVTCYLTWSPCPSCAGELVDFIQAHHHLTLRIFASRLYYHWLGHYQEGLLLLCGSQVPVEVMGLREFTDCWENFVDHEEPPSFNPSEKLEELDKNSRAIKRRLERIKQSRSVDVLENGLRSLQLGPVTPSSSRCNSR

SEQ ID NO: 416 - protein, 267 aa, Artificial Sequence
  source: /note="Description of Artificial Sequence: Synthetic polypeptide"
MGTPKDTKSRHLAGRCHELHNSRGRSPESDTMASEKGPSNKDYTLRRRIEPWEFEVFFDPQELRKEACLLYEIKWGASSKTWRSSGKNTTNHVEVNFLEKLTSEGRLGPSTCCSITWFLSWSPCWECSTAIREFLSQHPGVTLVIFVARLFQHMDRRNRQGLKDLVTSGVTVQVMSVSEYCYCWENFVNYPPGKAAQWPRYPPRWMLMYALELYCIILGLPPCLKISRRHQKQLTFFSLTPQYCHYKMIPPYILLATGLLQPSVPWR

SEQ ID NO: 417 - protein, 399 aa, Artificial Sequence
  source: /note="Description of Artificial Sequence: Synthetic polypeptide"
MTNPQIRNMVKRMKPGIFVSNFNNKPILSGRNTVWLCCEVKTKDPSGPPLDAKIFRDKVYSKAKYHPEMRFLRWFRKWRQLHRDQEYEVTWYVSWSPCTGCANSVATFLAEDPKVTLTIFVARLYYFWKPDYQEALRVLCQKRGSPHATMKIMNYNEFQHCWNKFVRGRREPFEPWENLPKHYTLLHATLGELLRHLMDPGTFTSNFNNKLWVSGQHETYLCYKVERPHNDTWVLLNQHRGFLQNQAPDIHGFPKGRHAELCFLDLIPFWKLDDQQYRVTCFTSWSPCFNCAQEMAKFISDNKHVSLRIFAARIYDDQGRCQEGLRTLHRDGAKIAMMNYSEFEYCWDTFVDRQGRPFQPWDGLDEHSQDLSGRLRAILQVTASSLFQGNKIMIPVSSW

SEQ ID NO: 418 - protein, 396 aa, Artificial Sequence
  source: /note="Description of Artificial Sequence: Synthetic polypeptide"
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFYWRKKFQKGLCTLWRSGIHVDVMDLPQFADCWTNFVNPQRPFRPWNELEKNSWRIQRRLRRIKESWGL

SEQ ID NO: 419 - protein, 367 aa, Artificial Sequence
  source: /note="Description of Artificial Sequence: Synthetic polypeptide"
MCPRCPRHVRVGSDSRVPYREFCRSFGYPVALARSAPWPGDDGALLGFYELRGTGGPLVQRGHATGCAARGHHPETLLFDAEGHLDSVLLTLGLGHGAATRVALFSSHAPCGHEALGCVSRILGFLEAHPGVRLEMYFAQFESGFAEAGRGYHRPPYGHRDGTDEGGSLRDLVSLRPRVTVAPISGGMWGKILRDFVSNVPPLALMNPVNHLRAREDSENAARLAGITGVWPPYVDLAPVPSKKSFSSSSPSSSSFPSSSSFPSSSSSTTSPLLGLFPTLDTFVVTVLTPAQTYAWPQAWTPNWRQPQPQVVRHMTLPDLPPPPKQKEKTIQEMLPPNGIIKDFTITQEKPVKQSADTTGKSDRGKK

SEQ ID NO: 420 - protein, 230 aa, Artificial Sequence
  source: /note="Description of Artificial Sequence: Synthetic polypeptide"
MAAGPAPEARSLMDEQTFLDNFNNLKYPRKTYLCYEVELLVGENHIPLDDYKGFVHNEGFDMGLERCHAELIFLERMASWNLDTELRYRITVFISWSPCPECADELVKFLRENRHVNLRIFAARIYDWYQGYEAGLRALKAAGAEVAMMTLHEFEYCWNNFVDHQQDEDTPFPPWDNLVARSEELSQRLEGILQPSVLVFCWPSQVSVTAAHSDIMSQASRAWEKRRDPP

SEQ ID NO: 421 - protein, 175 aa, Artificial Sequence
  source: /note="Description of Artificial Sequence: Synthetic polypeptide"
MIHVDQLLEADRIHHETWMQEALKEADKALVLDEVPIGAVLVYQGQIVGRGHNVRESQERALGHAELMAIETANQQLGHWRLEEASLYVTLEPCPMCAGALMNCRIKEVIYGASDLKAGCAGTLMNLLEEDRFNHRAQVIQGVLEQECSHKLSQFFKDLRQRKKMSKARQTEHKE

SEQ ID NO: 422 - protein, 156 aa, Artificial Sequence
  source: /note="Description of Artificial Sequence: Synthetic polypeptide"
MKLNQEEMDRYWMREALLLAEEAGKLGEVPIGAVIVRNGEKIGQGYNRREVDKNPLAHAEILAIQEASRTLKGWRLNGTTLYVTLEPCPMCGGAILQSRIPRLVFGARDPKAGAAGSILDLMHEPRFNHQVEVVEGVLAEEAGALLTQFFRRLRQR

SEQ ID NO: 423 - protein, 161 aa, Artificial Sequence
  source: /note="Description of Artificial Sequence: Synthetic polypeptide"
MSLKQSKEDIFFMEQALVEAEKAMEIGEVPIGAIIVRDNVIIARGHNLREQQQMVTNHAELIAIQKACEEVGSWRLEDCTLYVTLEPCPMCAGAIVQSRMKRVVYGAADPKAGCCGSLMNLLDEPRLNHQVYVTSGLYEEESSRLLKDFFKKLRQKKKGTD

SEQ ID NO: 424 - protein, 181 aa, Artificial Sequence
  source: /note="Description of Artificial Sequence: Synthetic polypeptide"
MQQQKGKEKLTDQERFMKEAIRQAKKAEALEEVPIGCVIVHEGKIIARGYNRRNTDKNTLSHAELNAIRKASKKLGDWRLEGCTMYVTLEPCQMCSGALVQSRIDEVVIGCMNAKAGCAGSVMNLLQVDGFNHQVKIIQGVLEEECSSMLSEFFRKLREKKKQEKAALKAAQENPEGEPEQ

SEQ ID NO: 425 - protein, 189 aa, Artificial Sequence
  source: /note="Description of Artificial Sequence: Synthetic polypeptide"
MNKITLNRGSMEENINFTDAERTAMNLALELAGKARERGDVPIGAVILYDGLKPDSPMGRLCREKGIFPGEILGTGFNQRNFHGNALCHAEILAIEEACKKIGDWRLEDCTLYVNLEPCPMCAGAILQARIPRLQMSVRNPKAGFCGSVMNILQMKELNHRVEITEGLQAEEARKLLQDFFAKLRLKEE

SEQ ID NO: 426 - protein, 164 aa, Artificial Sequence
  source: /note="Description of Artificial Sequence: Synthetic polypeptide"
METAFDLAKEALAANEVPIGCSFVYNGKVVASGRNHVNEYRNASLHAEILAIMELEQWCAIQNLDFAEVLSQSILYVTAEPCIMCAAALRFSLPGQPLKIVYSAKNERFGGCGSVLSIHSDPSPYPILVCEVDNRSDESIDLLKQFYKLENANAPESKRIKKRQ

SEQ ID NO: 427 - protein, 184 aa, Artificial Sequence
  source: /note="Description of Artificial Sequence: Synthetic polypeptide"
MREGNDEREVTERHEWFMRIALDQAEKALRDKEVPVGCVFVHADSGTVLATGANETNISLNGTRHAEFVGVDAILKQHPASILQETVLYVTVEPCVMCAAALRQLQIKHVYFGCGNDRFGGCGSVFSVHSDPVGRSVETPGYPVTSGIFSKEAIMLLRRFYLLQNDTAPNPALKAMRVLKEVED

SEQ ID NO: 428 - protein, 180 aa, Artificial Sequence
  source: /note="Description of Artificial Sequence: Synthetic polypeptide"
MEQLKNESETELQNQSEAEMRDEKYMKEALKQAKKAYALEETPIGCVIVHEGKIIARGYNRRNTDKSPLAHAEISAIKKASKKLGDWRLEECTLYVTLEPCQMCAGAIIQSRIPRVVVGCMNPKAGCAGSVLNLLDVQAFNHQAEVKTKVLEEECSLMMKQFFRELRAKQKMKKKSLLSE

SEQ ID NO: 429 - protein, 176 aa, Artificial Sequence
  source: /note="Description of Artificial Sequence: Synthetic polypeptide"
MVGGRSSRGRRSPCRLCVCQRWPSDRSSKESDQRMAQCKGSSHPLDIMRGRPVNEQATLHAELEAIDHLLPTNPAPLSSITLYVTVEPCVMCASALRQIGIGRVIYGCGNDRFGGCGSVINVNSSCVSPLDVLLCPNPPREMLDTHPPFVAEGGFYREEAIMLLRRFYMSENQNGQ

SEQ ID NO: 430 - protein, 209 aa, Artificial Sequence
  source: /note="Description of Artificial Sequence: Synthetic polypeptide"
MEGTAAASAAGDGSHAVSAEETAKWMEEAMRMAKEALKNTEVPVGCLMVYNNEVVGKGRNEVNQTKNATRHAEMVAIDQVLDWCRENDLRPSAVFEHTVLYVTVEPCIMCAAALRLMSILWPCKFKPCSFPNERFGGCDIASADLPNTGDNFRVLHTFSWAWFILLFSFHQCIPGYRAEEAVELLKTFYKQENPNAPKSKVRKKECQKP

SEQ ID NO: 431 - protein, 181 aa, Artificial Sequence
  source: /note="Description of Artificial Sequence: Synthetic polypeptide"
MPVMIVEKKSIARSHEYWMQRAIAEAGKARSRDEVPIGCVIVRDNRIIARGHNLRESSQDPSAHAEMIAIRKAARKLSSWRLLDTTLYVTLEPCTMCMGAIILSRIPRVVFGCLDPKGGAAGSLYDLSNDPRLNHRVELLPGVLERDCSSLLSGFFAELRRRRREARLSSAGELPGTPQGC

SEQ ID NO: 432 - protein, 160 aa, Artificial Sequence
  source: /note="Description of Artificial Sequence: Synthetic polypeptide"
MLSSEDNKWMKLALDEADKAEKIGEVPIGAVIVKGEEIIATAYNRREVDAQATAHAELIAIQKACQHLDAWRLSGCTLYVTLEPCPMCAGAIIQSRIDRVVFGAYDPKAGCAGSLMNLLQDERFNHQTEVDCGCLADECGGKLSTFFRALRQKKKGLKQK

SEQ ID NO: 433 - protein, 153 aa, Artificial Sequence
  source: /note="Description of Artificial Sequence: Synthetic polypeptide"
MVGCVFAIESDIIAESRNSVNATHNPTRHAEINCIDYVIEYCKANNIDYRLYFKNVTVYVTVEPCIMCAAALSNLGVKEVVYGCANDRFGGKTVLDISNFYEHNYNLIGNLMANEAMALLKQFYKGANPNAPESKVKKKQKKRQKAASATLRS

SEQ ID NO: 434 - protein, 169 aa, Artificial Sequence
  source: /note="Description of Artificial Sequence: Synthetic polypeptide"
MTEHEKFMNAALKLARKAAAEGEVPVGCVVVRDGVIVGRGRNRRETKKDALGHAEIEAIHKACKKLGGWRLHQCDLYVTLEPCPMCTGAIINARIKTVYYGAPDLKAGSCGSVVNLFDLPYNHKPELVSGLMEQECTEELQKFFRQLRERKKLEKQLRKQAQMNDLNEI

SEQ ID NO: 435 - protein, 165 aa, Artificial Sequence
  source: /note="Description of Artificial Sequence: Synthetic polypeptide"
MDQGTHEKWMNVALEEAAKAEEIGEVPIGAVIIKEGKLIASAYNLREANHSALAHAELLAIEQANKKLGAWRLEGCTLYVTLEPCPMCAGAIVQSRIPTVVYGAQDQKAGCAGTLMNLLQEQRFNHRCEVISGVLEEGCGEKLSAFFRKLRADQKRKKQDLQEGR

SEQ ID NO: 436 - protein, 149 aa, Artificial Sequence
  source: /note="Description of Artificial Sequence: Synthetic polypeptide"
MDEMYMSLALEEAYKAFSTYEVPVGAVIVHDSKVISRGYNKRETLKDPTAHAEIIAIKEASKYLGGWRLIGCTMYVTLEPCSMCAGAIINSRIERLVIGAKDPKRGCCGSVINLLDNPNFNHKVEVEFGILKDKCSNILTEFFKQIRCK

SEQ ID NO: 437 - protein, 179 aa, Artificial Sequence
  source: /note="Description of Artificial Sequence: Synthetic polypeptide"
MRELPYSPEELMRLAIREAKKAERNGDVPIGCLIVYDGRLPGSRADQRAEEQSIRPGEIIGRGYNRRNRDKSALKHAEISAISKACRRLGDWRLEDCTMIVTLEPCPMCAGAILQARIPRLLFGAENPKAGFCGSVLDILQLSALNHRVELLPPVLREDCKRLMTDFFGRLRAHSDSEE

SEQ ID NO: 438 - protein, 194 aa, Artificial Sequence
  source: /note="Description of Artificial Sequence: Synthetic polypeptide"
MVSHLSYKAEEALIAREIPVGCVFVRNNEIIARGRNRTNETRNVRPSSLSFLSLSNTHESQASIHAELAALSHILPNGSSRRQFEPLTDVTLYVTVEPCLMCASALRQVGIRKVIYGCANDRFGGCGGVLEIHNKYALFTSFHRAISMTRVPAPSCYIRNHWKLLEVTSAKRRSCFSGGSTSLRTRRVSMTWHL

SEQ ID NO: 439 - protein, 159 aa, Artificial Sequence
  source: /note="Description of Artificial Sequence: Synthetic polypeptide"
MERLQIKNDIEGMKEALIEAKKAFAIGEIPIGAIICDDKGNIISRGHNLREKTFDATAHAEIVAIRKACTKLQNWRLSDLTLYVTVEPCPMCAGAIFSSRLKRLVYGATDWRAGGCESVFNIVNNHWLNHQTQIRAGVLEDECSLLVKKFFQTRRQNHN

SEQ ID NO: 440 - protein, 168 aa, Artificial Sequence
  source: /note="Description of Artificial Sequence: Synthetic polypeptide"
MVNSSWERTADKMHEEFMRAAIEEAKKAEAIGEVPIGAVIVHDGGIIARAHNRRETSQNPLTHAEIIAIDAASEKIGSWRLEDCTLYVTLEPCVMCSGAIVMSRIPHVVYGAKDPKGGTVESLMHLLDEPRFNHRAYITAGVLGEECSSMLTLFFRKLRGRRKRRAED

SEQ ID NO: 441 - protein, 182 aa, Artificial Sequence
  source: /note="Description of Artificial Sequence: Synthetic polypeptide"
MDSWMEEAFVQANEALQVGEVPVGCVFVFNDQVIARSRNTVNETHNATRHAEMNCVDQTVTWCKETSHDFDEVMSAVKVWVTVEPCIMCAAALHSLRVAEVVYGCNNDRFGGCTSVFDTSLLYSPATPMKGGMQSDRAMQLLKDFYKGTNPNAPQPKVKKDKKVASISDVSEIQHNKEASDS

SEQ ID NO: 442 - protein, 178 aa, Artificial Sequence
  source: /note="Description of Artificial Sequence: Synthetic polypeptide"
MSGKVNDLNKDISNNVDLEESYDSKKANKYMKEAIKQAKKAASIGEVPIGCVIVYQDKIIGRGYNRRMVDKNTLSHAELNAIKKASKKLDDWRLDDCELYVTTEPCQMCAGAIVQARIKKVYIGCMNPKAGCAGSIMNLLQVDKFNHQVEMEKGILEEECSNLLKDFFRNLRKKQKDE

SEQ ID NO: 443 - protein, 169 aa, Artificial Sequence
  source: /note="Description of Artificial Sequence: Synthetic polypeptide"
MDYTIEEKAMFMREALKEAEIALANDEIPIGCVLVKDGQIIGRGHNAREELQRAVMHAEIMAIEEANQRENSWRLLDTTLFVTIEPCVMCSGAIGLARIPQVIYGATNQKFGGAGSLYDILADERLNHRVEVETGILEAECAAIMQTFFRQGRERKKQAKLAAKAETQE

SEQ ID NO: 444 - protein, 165 aa, Artificial Sequence
  source: /note="Description of Artificial Sequence: Synthetic polypeptide"
MNQSQDEHYMRRALDLARQAEQLGEVPVGAVVVLNGKVIAAAGNRRETWQDPTAHAELIALREAAKRIDSWRLEEATLYVTLEPCIMCMGGIILSRIPRLVFGARDPRVGAVGSVFDLADDERFNHRVEVSEGVLAEECSEILSNFFRQLRQKKKAARMRSAKDE

SEQ ID NO: 445 - protein, 190 aa, Artificial Sequence
  source: /note="Description of Artificial Sequence: Synthetic polypeptide"
MNLNMQMKPKALGRISTKGLTQEEIQDIKFMKAAITQARKAYVLGEVPIGCVIVYEGKIIGRGYNRRNTDKTTLAHAEITAIKRAGKVIGDWRLEGCKLYVTLEPCQMCAGAIVQARIPEVIMAAENPKAGCAGSVLDILNNPGFNHQVQVKRGVLKDECAKMLKEFFVELRARNKAEKELKSSQGLDEN

SEQ ID NO: 446 - protein, 168 aa, Artificial Sequence
  source: /note="Description of Artificial Sequence: Synthetic polypeptide"
MSSHPKDEYYMSLAIAEARKAEAIGEVPIGAVLVIDDEVVAAAYNLRESEHRAIAHAELLAIDQACKKTGAWRLSGSTLYVTLEPCAMCAGAIVLSRVDRVVFGAHDPKAGCAGSLMNLLEEERFNHVCDVTTGVRKEECSAMLSTFFRTLRQRNKEKRKQRLGDKQP

SEQ ID NO: 447 - protein, 127 aa, Artificial Sequence
  source: /note="Description of Artificial Sequence: Synthetic polypeptide"
MSYDLSRHFKYMAISLFVGYKALLNNETPVSCIVVNSKTDEIISIGYNYTNHSLNGTQHAEFIALQRFESDESINYSDLILYVTVEPCIMCASYLRQLGIGKVIFGCGNDRFGGNGSIASTQRSKFT

SEQ ID NO: 448 - protein, 164 aa, Artificial Sequence
  source: /note="Description of Artificial Sequence: Synthetic polypeptide"
MTIDEKYMRAAIRQAEKAGAMGEVPIGCVIVYEDKIIARGYNRRTIDKNVLSHAEINAIRKACRKVGDWRLEGCTMYVTLEPCPMCAGAIVQARIPKVIMGCMNAKAGCAGSVLDLFHQDGLNHQVETESGVLGDECSRLMKDFFKALREKSKKKPEGISFITP

SEQ ID NO: 449 - protein, 177 aa, Artificial Sequence
  source: /note="Description of Artificial Sequence: Synthetic polypeptide"
METVQFDHDSHNPIQAEHEKWMREAMLEADKAKALMEVPIGAVIVRGGEIIGRGHNLRETSLDPTAHAEIIAIREASEKLGAWRLLDCRLYVTLEPCPMCAGAIVQSRVPQVIYGTPDPKAGCAGTLMNLLQEERFNHCVDVISGVLQPECASQLTDFFRELRRRAKEAKKALPAEE

SEQ ID NO: 450 - protein, 159 aa, Artificial Sequence
  source: /note="Description of Artificial Sequence: Synthetic polypeptide"
MKTDEDFMELALEEARKALALEEVPIGAVVVCNGEIVGSGHNLKETENDPTAHAEIVAIRDAARKLSSWRLNECQLYVTIEPCPMCAGAIMQARLQRVVYGAVDPKAGVAGSLYNLLQDNRFNHTVELKSGVLAAECRQIIKDFFSELRQTRGRVGESG

SEQ ID NO: 451 - protein, 168 aa, Artificial Sequence
  source: /note="Description of Artificial Sequence: Synthetic polypeptide"
MEKEEASLQGIHERWMRQALEEADKAEQLNEVPIGAIIVKDQQIIGRGYNVRETQHQATGHAEIQAIEDANRHQQAWRLEGATMYVTLEPCPMCAGALINSRIQTVVYGASDLKAGCAGTLMNLLQDDRFNHQVEVISGVLAEECGDKLSYFFRKLRQRKGKNIDRAE

SEQ ID NO: 452 - protein, 150 aa, Artificial Sequence
  source: /note="Description of Artificial Sequence: Synthetic polypeptide"
MTADEEYMTLCIELAKKAAEKGECPVGAIVVDKDGRIIGEGYNMREAEQMPTAHAEIIAIEQAAKAMNSWRLTECTLYVTLEPCPMCAGAIINSRIKRLVYGAFDEKGGACASLMEIFDYPFNHRPMVRSRVLQDECAKLLTEFFKDLRT

SEQ ID NO: 453 - protein, 182 aa, Artificial Sequence
  source: /note="Description of Artificial Sequence: Synthetic polypeptide"
MTDTFTATPAHMQLALVQAQHAWDLGEVPVGAVVVKDGEVIATGYNQPIGKHDPTAHAEIMALRAAAEILGNYRLPGCELYVTLEPCVMCAGAMMHARLARVVYGAADPKTGACGSVVNLFAQEELNHHTELVGGVMAEACGQMLKSFFSERREQLKQERLQRQAIAHAHANAHSIDDEAND

SEQ ID NO: 454 - protein, 154 aa, Artificial Sequence
  source: /note="Description of Artificial Sequence: Synthetic polypeptide"
MHKIFLEEAYKEAIKALQEQEVPVGCVIVQNKQILSRSHNLTNKLHDPLAHAEINGLRELLQQSQITDDLTFYITCEPCIMCLGILNRIKARIYYGCKNIIFGGITILETPSDSHFIEDKRCYEILQKFYSNENEFAPEEKRKKKNNRNNGVPL

SEQ ID NO: 455 - protein, 159 aa, Artificial Sequence
  source: /note="Description of Artificial Sequence: Synthetic polypeptide"
MLTSLKATRHAEFLGIDEILSKYDKDVFKETDLYVTVEPCVMCASALRQLEIRKVYFGAANDRFGGCGSVLSLHNHAKLPEPAYNVYPGFYRDEAIVMLRKFYVQENTKAPVPRGKKTRELKLEVEDNFDYSKFVGSEEEFINVYGKERLSEYRKLSSK

SEQ ID NO: 456 - protein, 169 aa, Artificial Sequence
  source: /note="Description of Artificial Sequence: Synthetic polypeptide"
MKSDEFYMKLAIEEAKRAAEINEVPIGAVLVSNDEVIATAHNLRETEQRSIAHAELLVIDEACRRTGSWRLENATLYVTLEPCAMCSGAIVLSRVNRVVYGASDPKGGCAGTLMNLLQEKRFNHQAEVLSGVCEEECGQLLSSFFRGIRERKKKEKVNYIQQKSATSNE

SEQ ID NO: 457 - protein, 171 aa, Artificial Sequence
  source: /note="Description of Artificial Sequence: Synthetic polypeptide"
MRDNNLYMREALKEAYIAAELGEVPVGAVIVKAGEIIAKAHNMVEAYASSSAHAEMLAMDAAEARLGSKWLSGCELYVTLEPCSMCAGAMVLARLEKLCIGTMDPKNGASGSIFDITGSDSLNHRIDVERGILADECAEALTSFFRELRITKAQLRKSNIVKDKVDIPEEK

SEQ ID NO: 458 - protein, 151 aa, Artificial Sequence
  source: /note="Description of Artificial Sequence: Synthetic polypeptide"
MLEDFMRVALEEAKKAYKQGEVPVGAVIVKNGKVISKAHNETRQKKNAVAHAEILAIDKACKKLENERLVDTEMYVTLEPCAMCAGAIVQARIPEVMIGTRDLKSGAANTILNVLENEKLNHRAELRFGIFEEECSEILKTFFKELRDERK

SEQ ID NO: 459 - protein, 158 aa, Artificial Sequence
  source: /note="Description of Artificial Sequence: Synthetic polypeptide"
MTRDEMYMRKALELAALAADEDEVPVGAVVVKKSTGEIVGRGFNRREYGRSPLTHAEIVAIDEASRKLGGWRLIDCELFVTLEPCPMCAGAVINSRVERVVFGAYDKKAGSCGSVVDLFGLPYNHKPECIGGVLEEECAAVLTEFFKGLRKRKVKVNE

SEQ ID NO: 460 - protein, 191 aa, Artificial Sequence
  source: /note="Description of Artificial Sequence: Synthetic polypeptide"
MVTVTREFSPSDLAFMELALKQAKFAMSNLEVPVGCVVVVDGKIVASGCNRTNETRNATRHAEMEAIDLLLEQWQKAGLSQVEVAEKFSRCVLYVTCEPCIMCATALSILGIRDVYYGCANDKFGGCGSILSLHESGCEQLFRSSHENGFRCSGGLMASEAIALLRSFYEQGNPNAPKPHRPVRMTQEDST

SEQ ID NO: 461 - protein, 158 aa, Artificial Sequence
  source: /note="Description of Artificial Sequence: Synthetic polypeptide"
MPSHNNTDKYWMQQAIDQAKLAYNKGEVPIGAVIVKDEQLIATGFNKRETSQDATSHAEIIAIQSACNYLGGWRLLDCTLYVTIEPCPMCAGAILQSRITKLVFGTEDPKAWGELSISQLLQNPQLNHQVDIVEGICKEESKDIIKQFFHELRKRKKN

SEQ ID NO: 462 - protein, 152 aa, Artificial Sequence
  source: /note="Description of Artificial Sequence: Synthetic polypeptide"
MDRYMTRALELARLAFDEGEVPVGAVVVKKTTGEIIGEGRNMREGAKNALAHAEIIAIDQACRTLGGWRLPECAIYVTLEPCPMCCGAIINARIDNVIFGAYDLKSGSAASVQKMFELPYNYRPEVTGGIMEQECADILSEFFRQLRIRKKT

SEQ ID NO: 463 - protein, 197 aa, Artificial Sequence
  source: /note="Description of Artificial Sequence: Synthetic polypeptide"
MEQNSPGIRFANDAQKHAFFMKKALDMGEEALASGETPVGCVLVHNDEVIGSGMNDTNKSMNGTRHAEFLAIEEVLRSHPRSIFRETDLYVTVEPCIMCASALRQYQIRHVYFGCANERFGGTGGVLKLHSDPGIDPPYGLTGGLFRKEAIMLLRRFYIQENERAPNPKPKKDRELKDDDFGDVGAGMEFAGMLPRP

SEQ ID NO: 464 - protein, 166 aa, Artificial Sequence
  source: /note="Description of Artificial Sequence: Synthetic polypeptide"
MTDFELMGLALEEAAKAAALGEVPVGAVVARHGEVIATAHNTRETEKNALHHAELLAIDAACKALGGWRLWECELFVTLEPCPMCAGGIINSRLRRVVYGAADTKAGCCGSVTDLFALPFNHHPVVEKGLREAEAQQLLQAFFVSLREKRAGRPRWKPPVPENRGK

SEQ ID NO: 465 - protein, 152 aa, Artificial Sequence
  source: /note="Description of Artificial Sequence: Synthetic polypeptide"
MDHKDYMARALELAAQAAEHGDVPVGCVIVKDGKIVGEGRNRREEHGDATAHAELEAIRDACARLGSWRLHGCTLYVTLEPCPMCAGGIINSRIETVRYGARDEKAGCCSSVLNLFEERFNHHPRIYRGPLEPQCQKILQDFFLDLREDGEN

SEQ ID NO: 466 - protein, 188 aa, Artificial Sequence
  source: /note="Description of Artificial Sequence: Synthetic polypeptide"
MEEKVESTTVPDGSCVVSVQETEKWMEEAMRMAKEALENIEVPVGCLMVYNNEVVGKGRNEVNQTKNATRHAEMVPFDQVDWCHHTGQPSAVFEHTVLYVTVPCIMCAAVLALMSIPLAASGQRTDRRTTRRSALNIGFCFLFNAGRPFQCIPGYRAEEAVELLKTFYKQENPNAPKSKVRKKDCQKS

SEQ ID NO: 467 - protein, 151 aa, Artificial Sequence
  source: /note="Description of Artificial Sequence: Synthetic polypeptide"
MKEALKEARKAAEMGEIPVGAVIVKDGEIISRGHNLTETTKDPTAHAEMIAIREAAKLLRGWRLTGCDMYVTMEPCSMCAGALVWSRIEHLYIGADDPKTGACGSVFNIVQDDRLNHQIAVDRGIMAEESSQLVREFFRNLRNKTKKPEEE

SEQ ID NO: 468 - protein, 163 aa, Artificial Sequence
  source: /note="Description of Artificial Sequence: Synthetic polypeptide"
MSAQSEHEKWMARAIQLAKQAETLGEVPIGAVIVKEGEVLGEGYNRREIDRNPLAHAELMAIQQACERLGGWRLAGCDLYVTLEPCPMCAGAIVQARLRRVIYGTEDPKAGYAGSLHNTLQDERLNHQTDVIAGIRREECQHLLKDFFRRLREQKKAAKGMST

SEQ ID NO: 469 - protein, 155 aa, Artificial Sequence
  source: /note="Description of Artificial Sequence: Synthetic polypeptide"
MDRDNYFLKEAVKQAKKAGEIGDVPIGCVIVFEDKIIARGYNRRNKDKSTLSHAEIIAIKKACKKIGDWRLEDCTMYITLEPCPMCAGAIIQSRIKRVVLGAMNPKAGCAGSIINILQTEGFNHKTEISLIDEPLHSECVSLLTSFFKALRENKK

SEQ ID NO: 470 - protein, 181 aa, Artificial Sequence
  source: /note="Description of Artificial Sequence: Synthetic polypeptide"
MPELIHVMNLSNEEREDHEYWMKEAMKEALKAQEKDEVPIGAVIVYQGRIIGRGHNIRETQNLATGHAEIQAIEAANHYLGAWRLEGARLYVTLEPCPMCAGAAVLARIETIIYACRDPKGGCTGSLMNLAQEDRFNHQTQVIEGVLDAACSQMMKDFFKKLRKRKKLEKLSTKTVDNADL

SEQ ID NO: 471 - protein, 99 aa, Artificial Sequence
  source: /note="Description of Artificial Sequence: Synthetic polypeptide"
MDLTQHFQRMGLSLFVAFKALSINETPVACILVSKKSSQVISIGYNDTNRSLNGTRHAEFIAIDYVLDNVVDTLPVDDLILYVTVEPCIMCASALKQVG

SEQ ID NO: 472 - protein, 162 aa, Artificial Sequence
  source: /note="Description of Artificial Sequence: Synthetic polypeptide"
MEGIQHELFMREALKEAEKARELDEVPIGAVVVRDGEIIGRGHNLRESTRNATMHAEMVAIQEANEQLANWRLEECDLYVTVEPCVMCGGAIIWSRMRTVYFGAHDPKGGAAGSLLNVLEDDRFNHTATVYSGLLAEESQRLLKDFFRELRKRKKQKNGEHA

SEQ ID NO: 473 - protein, 98 aa, Artificial Sequence
  source: /note="Description of Artificial Sequence: Synthetic polypeptide"
MVELEKHYEFMRYALRLANNALHTNEVPVACVFVYDGQIISYGSNNTNDSLSGITHAEFRGINIILDKVKSSPDFQQVYQNPQDIFKDIDLYVTVEPC

SEQ ID NO: 474 - protein, 202 aa, Artificial Sequence
  source: /note="Description of Artificial Sequence: Synthetic polypeptide"
MNDSTEQTDSDLQLEQEHIQWMRVAMEMAEEALVAKEVPVGCIFVRDGRIIARARNRTNELRNATRHAELEAIDGILSDKDLTPVLTDYPLSETTLYVTVEPCIMCASALRQMGIKKVFYGCANDRFGGCGSVLGVNRSLTHPRHPAYQAVGGYLREDAIMILRRFYVTENTNAPAPKSKANRVTTKCITSAIYVYYRSSRI

SEQ ID NO: 475 - protein, 159 aa, Artificial Sequence
  source: /note="Description of Artificial Sequence: Synthetic polypeptide"
MTSHQYYMSLALEEAREAAKKGEVPIGAIIVKNEKVIARAHNLRETNQNPTAHAEHLAIEQAAETLGTWRLEGCTLYVTLEPCVMCAGTIVMSRVDTVVFGAYDPKGGCTGSLMNLVQDQRMNHRAKVIEGVLAYSCGEILRQFFRTLRQRKAAKAMSN

SEQ ID NO: 476 - protein, 120 aa, Artificial Sequence
  source: /note="Description of Artificial Sequence: Synthetic polypeptide"
MVSSSKTVKLSLEPEIGPTSGEMCVILSLPYRSSSDLPQATLHAELEAIDHLLPNNPAPLSSITLYVTVEPCVMCASALRQIGIGKVIYGCGNDRFGGCGSVINVNSSFVLLGRVGEAGC

SEQ ID NO: 477 - protein, 165 aa, Artificial Sequence
  source: /note="Description of Artificial Sequence: Synthetic polypeptide"
MSPGYRGYADLVSLPVPAADDAAMTRALELAADAPAHDDVPVGAVVTRGGQVVGEGRNLRERDGDPLAHAEIVALRAAASALGSWNLEDCTLVVTLEPCVMCAGAILQTRVGRVVFGAWDEKAGAAGSVHDLLRDRRMPHRAEVLGGVRAAESAALLRDFFGQKR

SEQ ID NO: 478 - protein, 154 aa, Artificial Sequence
  source: /note="Description of Artificial Sequence: Synthetic polypeptide"
MVLEENFMLEAIEEAKKAFNKKEVPIGAVVVKDNEIIGRGHNLRETTKNSISHAEIMAIQEACKFLGGWRLTDCTLYVTIEPCPMCAGAILQSRIQKVVIGAMDPKAGACGSLVNLLNDSRFNHQTEIEQGVLEEECSLLMKEFFKALREKRFG

SEQ ID NO: 479 - protein, 162 aa, Artificial Sequence
  source: /note="Description of Artificial Sequence: Synthetic polypeptide"
MKHITYMQAAIEEAKKAQNLGEVPIGAVIVKDGEIIARGYNLRETSQLSNAHAEMIAIAKANEMVGSWRLEDCTLYVTLEPCPMCAGAIVQSRIPTVVFGAHDPKGGCCGTIYNLLDESKFNHRCELVSGVLEEECGQLLSDFFRNLRQKKKQQRVDNETSN

SEQ ID NO: 480 - protein, 168 aa, Artificial Sequence
  source: /note="Description of Artificial Sequence: Synthetic polypeptide"
MRTDNDYMRLAIKEARKAQELGEVPIGAVIVKDNHVIARAHNLRETLQQPTAHAEHIAIERASEVIGSWRLEDCTLYVTLEPCVMCAGAIVMSRIPRVVYGAIDPKGGCTGSLMNLLAQPQFNHRAIVESGILENECSTLLREFFKNIRQQKRSLKQAKIQNDTNLLE

SEQ ID NO: 481 - protein, 181 aa, Artificial Sequence
  source: /note="Description of Artificial Sequence: Synthetic polypeptide"
MDTNEPLTNGAGASEQDLQFMGQAILEAKKAEAIGEVPIGAVIVRDGKVIAASHNLRERDQEATAHAELAAITEACRKTGSWRLEDTVLYVTLEPCPMCAGAILQSRIPRVVYGARDPKAGCVDSLYRLLDDPRFNHRCDVTEGVLADECGALLTNFFRGIRKRRKAEKQARRALESEQGE

SEQ ID NO: 482 - protein, 155 aa, Artificial Sequence
  source: /note="Description of Artificial Sequence: Synthetic polypeptide"
MSRDEYFMDIALKEAKKAYNKGEVPIGCVIVKDDKIVSRGHNQVLSKKSGVNHAEIIAINKAGQKLGDFRLEDTELFVTLEPCCMCAGAIVNSRIKRVIIGAMDVKRGFCGSIENVLDRQELNHRSIIKTGVLEQKCLDILQDFFKNLRSEKKNK

SEQ ID NO: 483 - protein, 174 aa, Artificial Sequence
  source: /note="Description of Artificial Sequence: Synthetic polypeptide"
MKTSQQLKDEAYMKEALTEADKAEAIGEVPIGAVIVKDDIIIARGYNERETKQRATGHAELVAIEEACRILKTWRLEGCTLYVTLEPCPMCAGAIVQSRIDRVVYGADDPKGGSCGTVVNLLDEPKFNHAPLVTSGTLKEEAADRLSSFFRALREARKQKKKEGIPHETESDFT

SEQ ID NO: 484 - protein, 151 aa, Artificial Sequence
  source: /note="Description of Artificial Sequence: Synthetic polypeptide"
MNHEYFMKIAIEEAKKCLFLDEVPVGAIIVKDGKIIARAHNLRETLRDATAHAEILAINEACMALGGWRLLDCTMYVTLEPCPMCAGALVNSRIKTLIFGTRDPKGGACGSLYNIVADERLNHRIEIIEGVLQDECSKLLKEFFKSKRKKD

SEQ ID NO: 485 - protein, 197 aa, Artificial Sequence
  source: /note="Description of Artificial Sequence: Synthetic polypeptide"
MIVLERRPVYASNSSQAERLLRCDCVLNSGYGTLMVRIVHFSMSGAEQMEHEKFMREALQEAEKAIKWGEVPIGAVVVREGQVIARGHNMRETWKDPTAHAEIVALREASRVLGGWRLTGCKLYVTLEPCPMCAGAILLARIDEVIFGAREPKFGAAGSIVNLIETDRFNHQPQLTSGVLAEECGMILKEFFRQRRK

SEQ ID NO: 486 - protein, 171 aa, Artificial Sequence
  source: /note="Description of Artificial Sequence: Synthetic polypeptide"
MTNLERDEKMMRRALELARQAALEGEVPVGAVVARGDEIIAEGRNRREACKNALCHAEIEAIDAACRALHGWRLWECDLYVTLEPCPMCTGAILNARIARVIFGASDPKAGSCGSIVNLFDLPYNHHPQLVSGVLREECGEVLTEFFQRLRDQRAVKKPSEPKSPAKDGTE

SEQ ID NO: 487 - protein, 157 aa, Artificial Sequence
  source: /note="Description of Artificial Sequence: Synthetic polypeptide"
MNREHEAWMDLALDEARAALATDDVPIGAVVISPDGKLLSTGRNEREALKDPTAHAEVVAIRNAVSALAARGADDGWRLEDCTLVVTLEPCAMCAGAIVLARIPRVVFGAWDEKAGACGSVFDIVREPRLNHWVEVYPRVREQECADLLRDFFRSKR

SEQ ID NO: 488 - protein, 182 aa, Artificial Sequence
  source: /note="Description of Artificial Sequence: Synthetic polypeptide"
MEAKVGSTQITGGACSVLAEETEKWMEQAMQMAKEALENIEVPVGCLLVYNNEVVGKGRNEVNQTKNATRHAEMVAIDQALDWCRRHGKSPSEVFEHMVLYVTVEPCIMCAAALRLMKIPLVVYGCQNERFGGCGSVLDIASADLPNTGRPFQCFEILKKLPIPQASGCCVFYFYLVGLGCG

SEQ ID NO: 489 - protein, 155 aa, Artificial Sequence
  source: /note="Description of Artificial Sequence: Synthetic polypeptide"
MESDRYYMKKAIEEAEKAEALGEVPIGAVLVHEGEVIARGHNLRETTQKTSSHAECITIDRANDVIGSWRLEECTLYVTLEPCPMCAGAILQSRIPVLVYGAYDRKAGCAGTLMNLLDDDRFNHRTAIRAGVMEEECGEMLSSFFRRIRKKRKDK

SEQ ID NO: 490 - protein, 149 aa, Artificial Sequence
  source: /note="Description of Artificial Sequence: Synthetic polypeptide"
MHIQAEEALHSDEVPVGCVFVKGDTAIARARNRTNEWRNATLHAELEAIDHLLPDHPAPLSEITLYVTVEPCVMCASALRQIGIGRVVYGCGNERFGGCGSVIDIHASYVLVLTSSGAKAGAGRRVGSHSESRPSRRESRRNARTEARL

SEQ ID NO: 491 - protein, 167 aa, Artificial Sequence
  source: /note="Description of Artificial Sequence: Synthetic polypeptide"
MEEEEAATLDWMDQAFDMAKEALECGEVPVGCLLVHNGQAIGRGRNEVNETKNATRHAEMVAIDRVLDWCKQHNRDYTEVFPQTVLYVTVEPCIMCAAAVRLMSILSCLFMLGNQMLKCYSFGNTGEPFECVSGYRAKEAVEMLKAFYRQENPNAPKSKVRKKDHRN

SEQ ID NO: 492 - protein, 162 aa, Artificial Sequence
  source: /note="Description of Artificial Sequence: Synthetic polypeptide"
MLPLDDPDTRFMQQALTLARSAPLIGEVPIAALLVHEGIVIAQAHNLRETRQDPTAHAEVIVIQDAARHMGSWRLINTTLYVTLEPCTMCIGAIVLARIPRLVFAATDPKAGACGSIMNIPPEPRLNHRVEVVGGVCAEESQALLQDFFQQLRKDAARRETT

SEQ ID NO: 493 - protein, 182 aa, Artificial Sequence
  source: /note="Description of Artificial Sequence: Synthetic polypeptide"
MVRPQAEEAFTASEIPVGCVLVHQGRIIAKGRNRTNEGRNATLHAEFDALRHLLPDRSHTVTPQLTRPFTPQEGERKIWETPLEGVVLYVTVEPCIMCAAAMRQVGIEKVIYGCGNDRFGGTGGVQSIHSESVRFPFDLLDRVANSCLVRSFVALDCCTLRRIQLTAITEEKRRLCCYGDSI

SEQ ID NO: 494 - protein, 169 aa, Artificial Sequence
  source: /note="Description of Artificial Sequence: Synthetic polypeptide"
MQEDAYYMRLALEEAQKAYDLEEVPIGAVLVDREGEVVARGHNMREVWHDATAHAEMIAIREACAKEGRWRLSGLTLYVTIEPCPMCAGAIVMSRVDRVVYGSTDARAGACESVFNIPGCPALNHRPEMTAGVLQEECAGIMKRFFKERRAKRKALRQQAAGSPETAER

SEQ ID NO: 495 - protein, 146 aa, Artificial Sequence
  source: /note="Description of Artificial Sequence: Synthetic polypeptide"
MATRHAELEAIDFILSQHPPKEQDFPISPHSGPSGDNPFAETTLYVTIEPCIMCASALRQVGIKRVVFGAGNERFGGNGSVLPVHTDAQLKNAPAYEAVGGYYREDAIMLLRRFYLTENVFAPNPRSKAKRVLKTYFQRESRPFCF

SEQ ID NO: 496 - protein, 150 aa, Artificial Sequence
  source: /note="Description of Artificial Sequence: Synthetic polypeptide"
MGVARTLAEQASAEGEVPVGALVVKDGEIIGRGYNQPIGRHDPSAHAEMQALRDAAARLGNYRLDGCDLYVTLEPCPMCSGAILHARIARVIYGAADAKTGAAGSTVDLFADARLNHHAAVFGGVEAETCAEQLSAFFRQRRRSAGDGEE

SEQ ID NO: 497 - protein, 160 aa, Artificial Sequence
  source: /note="Description of Artificial Sequence: Synthetic polypeptide"
MEQENYMRRALTLAREAGDAGEVPVGCVIVRDGKVVGEGRNRREELTSAASHAEMEAIAAANERLGSWRLEGCALYVTLEPCPMCAGAILNARVSKVFYGARDPAFGACGGVTNLFMEDFPNRPALVGGVLAEECREVLRAFFQKLRNDGGTGESPEPKI

SEQ ID NO: 498 - protein, 154 aa, Artificial Sequence
  source: /note="Description of Artificial Sequence: Synthetic polypeptide"
MEDDIKYMKMALAEARKAYQRAEVPIGAVVICDDKVVGRGFNLREQTQDPTSHAEMIALREAAKNEASWRLENCQLYVTLEPCPMCAGAILQSRIKRLVYGASDPKAGAVNSLYQLLNDERFNHQVEVEAGVMKKEAAQLLKDFFRDLRERKDG

SEQ ID NO: 499 - protein, 159 aa, Artificial Sequence
  source: /note="Description of Artificial Sequence: Synthetic polypeptide"
MQEALVEASAAARLGEVPVGAVVVKDGMIIGRGHNLRETSNDPTTHAEMIAIRQAAAAIDSWRLIGCTLYVTLEPCVMCMGAIILARIPRLVFGSRDPRVGAVGSIFDLSRDERFNHQVAVTEGVLALESSDMLSGFFRQLRAEKKSRKRKAADSEDQT

SEQ ID NO: 500 - protein, 151 aa, Artificial Sequence
  source: /note="Description of Artificial Sequence: Synthetic polypeptide"
MNDNDFMGEALRLAGCAAERGEVPVGAVVVCDGQIVGTGFNRRETGKNALAHAELEAIDAACRRLGGWRLHRCELYVTLEPCPMCAGAIINARIRRLVFGARDPKSGCFGSVSDFNALAFNHKPQVVCGVRGEECAQILSAFFQKLRRGRQ

SEQ ID NO: 501 - protein, 175 aa, Artificial Sequence
  source: /note="Description of Artificial Sequence: Synthetic polypeptide"
MEKDIEFMKQALIEAEKAFTLDEAPIGAVIVYKEQVIGRGHNRRNTDKNALAHAEVMAINEACKHIKDWRLEECTIYITLEPCPMCSGAIVQARLPRVVFGARSPKAGFGGSVLNILQMDELNHRCEVVEGVCEEEASQLLKSYFKQMRQKNKIIGGELWQQIQDIRKQECLEIL

SEQ ID NO: 502 - protein, 112 aa, Artificial Sequence
  source: /note="Description of Artificial Sequence: Synthetic polypeptide"
MVYNNEIVGKGRNEVNETKNATRHAEMVAIDQVLDWCQQHKKQPEDVFTHTVLYVTVEPCIMCAAALRMMNIGEPFQCIAGYRSEEAVEMLKTFYRQENPNAPKSKVRKKEF

SEQ ID NO: 503 - protein, 155 aa, Artificial Sequence
  source: /note="Description of Artificial Sequence: Synthetic polypeptide"
MKDHSYYMEMALEEARRAYAKGEVPIGAVLVVDGEVIAKAHNTREEHQQALNHAEMLAIKEACEKQGFWRLDNSYLYTTVEPCVMCSGAIVQARVENVIYGASDPKYGCCGSCIDLVGENKFNHQAEVISGVLEEECSMLMKNFFKELREKKKKQ

SEQ ID NO: 504 - protein, 158 aa, Artificial Sequence
  source: /note="Description of Artificial Sequence: Synthetic polypeptide"
MKFSEEKNLSFMQMALDQAQLAQADGEVPIGCLIVDNQTSEIIATGFNEREQTQDAIKHAEIIAIEKACQKVGSWRLEHTSLYVTLEPCPMCAGAIINSRIEEVIFGAYDPKAGSVGSINNLFEEKRYNHHPDFLGGMLADDSASLLQNFFREIRRKK

SEQ ID NO: 505 - protein, 161 aa, Artificial Sequence
  source: /note="Description of Artificial Sequence: Synthetic polypeptide"
MMEQAADERFMRRALELAEEAARWGEVPVGAVVVENGRIVGEGFNRRETWRDGTAHAEMLAIEEASRRLGGWRLTNCVLYVTLEPCPMCAGAIVLSRVQRVVYGATDAKGGAVASKVRLLEPGLWNHAPQITSGILADDCAKLLTDFFRKRRLKRRDGEVS

SEQ ID NO: 506 - protein, 168 aa, Artificial Sequence
  source: /note="Description of Artificial Sequence: Synthetic polypeptide"
MEEFNEKWMKVAIELAEKALAQGEVPVGCIFVRGEEIIAKGRNDVNRTRNATRHAEMICIDEVFERFKTTDVFKEVTVVVTVEPCIMCAGALHDLGVRGVVFGCANDRFGGCGSVFDVAAVHHTPVPVHGGVFASKAMELLKTFYMGVNPNAPPSKVKTRKKTELSMN

SEQ ID NO: 507 - protein, 195 aa, Artificial Sequence
  source: /note="Description of Artificial Sequence: Synthetic polypeptide"
MRQRSKIFMHLRQVLFYSEELQKCTDQKGGDRMHGEDERYMALAIDEAAKARAIGEVPIGAVIVREGAVIAQAYNQRETLQEPTAHAELSALREAGRKLGTWRLTGCTLYVTLEPCPMCAGAVVLSRIDRLVFGAPDPKAGCAGTLMNLVQDSRFNHQAEVAGNVLGEQCGALLTDFFSNLRREKRGRANDRPEI

SEQ ID NO: 508 - protein, 177 aa, Artificial Sequence
  source: /note="Description of Artificial Sequence: Synthetic polypeptide"
MPLLSLECYPLSDAELTHEYWMRHALTLAQRAWDEGEVPVGAVLVHNNQVIGEGWNRPIGRHDPTAHAEIMALRQGGLVQQNYRLLDTTLYVTLEPCVMCAGAMVHSRIGRLIFGARDAKTGAAGSLIDVLHHPGMNHRVEVVEGILRDECAGMLSAFFRQRRAEKKALKKGATDVL

SEQ ID NO: 509 - protein, 178 aa, Artificial Sequence
  source: /note="Description of Artificial Sequence: Synthetic polypeptide"
MGEYFMRKYTEDEKFMKEAIKQAKKAEAIGDVPIGCVIVHDGKIIARGYNKRNKDKTVLAHAELLAMKKACKKLGDWRLEDCTMYITLEPCQMCAGAIVQARVTRVVIGSMNAKAGCGGSILNLLEMQEFNHQAEVERGVLQEECSEMLSAFFRKLREIQKEKKKKRKLIQEENQTDN

SEQ ID NO: 510 - protein, 164 aa, Artificial Sequence
  source: /note="Description of Artificial Sequence: Synthetic polypeptide"
MKTHEEYMELALEEARKAEEIDEVPVGCVIVCDGEVISRGHNLKEQLNQAYAHAEMMAIQKAAEVKGNWCLNDCDLYVTLEPCMMCTGIINLSRIRTVYYGTQDPKGGCLETVIDLKKINRLNHYPNIVGNILQKECSEILTNYFRKKREIIKEKKQKNKANIQ

SEQ ID NO: 511 - protein, 152 aa, Artificial Sequence
  source: /note="Description of Artificial Sequence: Synthetic polypeptide"
MQEKDHEFFMREALKEARKAFEQDEVPVGAVIAYEGSIIARAHNLRERSQDATAHAEVLAIKAACEAMGTWRLTGCSLYVTLEPCPMCAGAIILARLDRVVFGAPDPKAGAAGSVVDLFKVERFNHHPEVVSGVLAEECGILLKDFFRQKRL

SEQ ID NO: 512 - protein, 159 aa, Artificial Sequence
  source: /note="Description of Artificial Sequence: Synthetic polypeptide"
MVQNAGNSLAGQRDVHFMEMALEEARQAAREGEIPVGAVLVRDGQVLARDHNRREQDRDATAHAEFLVIRQACRLLRRWRLSDTTLYVTLEPCPMCAGAIWNARVGRLVYGAWDSAAGSCGSQFNLPAHPSLNFRTEVTAGVLEEECRKILQDFLKARR

SEQ ID NO: 513 - protein, 214 aa, Artificial Sequence
  source: /note="Description of Artificial Sequence: Synthetic polypeptide"
MQEVGVDPEKNDFLQPSDSEVQTWMAKAFDMAVEALENGEVPVGCLMVYNNEIIGKGRNEVNETKNATRHAEMVALDQVLDWCRLREKDCKEVCEQTVLYVTVEPCIMCAAALRLLRIPFVVYGCKNERFGGCGSVLDVSSDHLPHTGTSFKCIAGYRAEEAVEMLKTFYKQENPNAPKPKVRKDSINPQDGAAVIQVMRGPPDEETETIAHLS

SEQ ID NO: 514 - protein, 154 aa, Artificial Sequence
  source: /note="Description of Artificial Sequence: Synthetic polypeptide"
MTEQQYYMTEALIEAKKAFALKEVPIGAVMVRKGEIIARGYNLRNSAKNPLCHAEIDVIDKSAKIVGDWRLEDCTLYVTVEPCPMCAGAIVQSRIPKIVFGTRNNKAGCAGSILNILQEPRFNHQVEIEENVLQQECAELMRAFFKNFRKKSNM

SEQ ID NO: 515 - protein, 153 aa, Artificial Sequence
  source: /note="Description of Artificial Sequence: Synthetic polypeptide"
MELATDEEKMYMEEALKEAALAALEGEIPVGAILVQDGRVIARNHNRRERAHDATAHAEILVIREACEKLRRWRLADSTLYVTMEPCPMCAGAIYNARIGRVVFGASDSVAGACGSLFQIPLHPSLHANTIIKAGIEAERCKKILQEFFTRRR

SEQ ID NO: 516 - protein, 161 aa, Artificial Sequence
  source: /note="Description of Artificial Sequence: Synthetic polypeptide"
MAKVPTFSEQQIDYFMQEALNEAKLAGSEGEVPIGAVIVFENQIIARAHNHRERDQLATAHAELIAIERANQALKSWRLEDTALFVTLEPCIMCAGAIINARVPAVYYGAQDAKGGGTQSLYQLLEDERLNHRVAVQAGVRAEESTKILQQFFADIRAKRK

SEQ ID NO: 517 - protein, 171 aa, Artificial Sequence
  source: /note="Description of Artificial Sequence: Synthetic polypeptide"
MCVCVCLQPNMDHFMEQALEQARKAEQLKEVPVGCVFVYRGEIIANGCNLVNETKNATRHVEFICIDQVLEYCKNRSLKHEDVFREVTVVVTVEPCIMCAAALIELNVREVIYGCKNDRFGGCTVLDVPGLLKTSIPIRGGVRADEAMELLKEFYKGENPSAPVPKVKSQK

SEQ ID NO: 518 - protein, 153 aa, Artificial Sequence
  source: /note="Description of Artificial Sequence: Synthetic polypeptide"
MDHEKFMAEALKEAEKAALQGEVPVGAVVVYNGEIIGRGHNLRETFSDPTAHAEIVALKEAASKLKNWQLKDCTLYVTVEPCPMCAGAIYQARIKTLVYGAPDLKAGAVDTLFDLVRNPRLNHRVEVISGVLAAEASKIITDFFREKRNRGKF

SEQ ID NO: 519 - protein, 150 aa, Artificial Sequence
  source: /note="Description of Artificial Sequence: Synthetic polypeptide"
MRNNYINLVIETALNEAEIALLEGEVPVSCVMKFGNIIIKTHNTTNKSCDPLKHCELDAIREYQRFHMSNTNDIIMFITLEPCTMCCRIITDFKERFIKCNLKLFFGVYNDIFGNLKITGNTFGECIYDERCIEIIKRFYEQQNPNTVNI

SEQ ID NO: 520 - protein, 169 aa, Artificial Sequence
  source: /note="Description of Artificial Sequence: Synthetic polypeptide"
MYTDQFYMKIALEEARKASAIGEVPIGAIVVKDNEVISRAHNLRESTQDPTAHAEHIAIQKAAKQLNSWRLASCKLYVTLEPCVMCSGAIVMSRIPEVIYGAQDLKGGCAGSLMNLLQESRFNHRAKITTGVLAEECSHLLKTFFKDIRQKKKIIRTEDNTNSETFGKI

SEQ ID NO: 521 - protein, 169 aa, Artificial Sequence
  source: /note="Description of Artificial Sequence: Synthetic polypeptide"
MTDEDYMELALAEAIKAAQLGEVPIGALLVYQDEVVAKAFNLREALQTTASHAEMLVIDKGNEVINSWRLEDCTLYVTLEPCPMCAGAILQARIPRVVFGAYDPKAGCAGSILNLLDDKRFNHQVEVTRGVLAEACGHLLKDFFKQLRSRKQEAEVVSLADYKEENNNG

SEQ ID NO: 522 - protein, 127 aa, Artificial Sequence
  source: /note="Description of Artificial Sequence: Synthetic polypeptide"
MAPDLSQHFKFMAVALFVGYKALLKNETPVACVVTRGCQIISIGYNHTNITLNGTKHAEFIALGRLKEPVDYKNLTLYVTVEPCIMCASYLRQLGLKNVIYGCGNDRFGGAGTILPLHNDPKLPHKP

SEQ ID NO: 523 - protein, 170 aa, Artificial Sequence
  source: /note="Description of Artificial Sequence: Synthetic polypeptide"
MVSLSVPLSSHSFPPTLAPSRAKLNDLYAGAQGEEALDVREIPVGCVLVHEGKIIARGRNRTNEGRNATLHAEFDALRHLLPDRSPSQTPGLVRPYTPQTDDVLAAAGYDSAAGRKVWQTPLKGVVLYVTVEPCLMCASAMRQVGIEKVVYGCANDRFGGNGGVQSIHAE

SEQ ID NO: 524 - protein, 182 aa, Artificial Sequence
  source: /note="Description of Artificial Sequence: Synthetic polypeptide"
MTKDLMDSTELNTMDERSRDEYFMSLAIEEGKKAYALGEIPIGAILVHNNQVISRHHNRRELDHDATAHAEVLVIREACNSLKRWRLTGCTLYVTIEPCPMCAGAIINSRIDRVVYGASDYKGGAVESLFNVLSHPGLNHEPQLQAGILADECSQLMKDFFKERRKARRSTQEAEGSALEMR

SEQ ID NO: 525 - protein, 147 aa, Artificial Sequence
  source: /note="Description of Artificial Sequence: Synthetic polypeptide"
MFNKFMAEAIEEAKKALAEDEVPVGAVITHRGKIIAAAHNLRETLNRATAHAEILAIEKACSILNSWYLTDCDLYVTLEPCIMCAGAIVNARIRSLYFGAFDPKAGACGSVIDVFRLKELNHRVTVYAGIMEDECASLLTKFFRSKR

SEQ ID NO: 526 - protein, 160 aa, Artificial Sequence
  source: /note="Description of Artificial Sequence: Synthetic polypeptide"
MTVNTGSMHETWMRLALEQAERAGREGEVPIGAVIVKDGAALAVGRNRRETDHNALAHAEAEAIRAACAALGSWRLSGCTLYVTLEPCPMCAGAIINARVDTVVFGAYDPKAGASGSVIDLFSCPFNHHPAVMGGVLEEDCRRLLQDFFAGLRRPKNDGC

SEQ ID NO: 527 - protein, 161 aa, Artificial Sequence
  source: /note="Description of Artificial Sequence: Synthetic polypeptide"
MNHEIFMQMAIDEAKKAYKINEVPIGAVVIKHGEVIGRGHNLRESSQNPLMHAEVVAINEASKNIGSWRLEECVLYVTLEPCVMCSGAIVMSRIPTVVYGAHDAKGGCSGSLMNLLHESRFNHQATVIAGIKHEECSMLLKDFFKSLRNNKLLEKNKKLEE

SEQ ID NO: 528 - protein, 160 aa, Artificial Sequence
  source: /note="Description of Artificial Sequence: Synthetic polypeptide"
MPTLEYQKDDFFFMRQAIQEAKRAMEIDEVPIGAVIVKADEVIARAHNLRETLQDATAHAELLAIRKACEVLGTWRLEGCTLYVTLEPCPMCAGAVILSRVDRLVFGAKDPKGGACGSLMNLPADERFNHRPKIAAGIMADECGNILKKFFQDKRMNKKA

SEQ ID NO: 529 - protein, 201 aa, Artificial Sequence
  source: /note="Description of Artificial Sequence: Synthetic polypeptide"
MDEPITEHEITPAVSENSKHASWMKQALMMGEQALEHGETPVGCVLVYDNKIVGRGMNDTNRSMNGTRHAEFLAIAEMLQSYPKSALQSTDLYVTVEPCIMCASALRQYGIRSVYFGCANDRFGGTGGVLNIHSDRSIDPPYPVYGGLFQKEAIMLLRRFYIQENDKAPKPRPKRNRELNTAFDRVPEIGGANGGNIEQSS

SEQ ID NO: 530 - protein, 184 aa, Artificial Sequence
  source: /note="Description of Artificial Sequence: Synthetic polypeptide"
MWRGTCGRDKKLTVNKKFMEQFMSEAFIEAKSVLEAGEVPVGCIFLYHGDGKNEVIARAGNNVNATKNATRHAEFLCIDQTLEFCTRNSLSIKDVFSKISVVVTVEPCIMCSAALHDLGVKEILYGCANDRFGGKTLVDVPFVTNRRDGQTQVNGGVCADEAMALLKDFYKGDNPSAPITKTKR

SEQ ID NO: 531 - protein, 155 aa, Artificial Sequence
  source: /note="Description of Artificial Sequence: Synthetic polypeptide"
MENNDEKFMMKAIEQAKIAYDMDEVPVGCVIVKDGEIIAQAYNSVEKDKNATMHAELKAINQATEFIGNFRLDDCIMYVTLEPCVMCTGALVYSRIPKVVFGAFDKKRGACGSLISLNDYEGLNHKIEVKSIMEKECVELMQSFFRRIREKNRNK

SEQ ID NO: 532 - protein, 97 aa, Artificial Sequence
  source: /note="Description of Artificial Sequence: Synthetic polypeptide"
MMDLTNEFGFMAIATFVAFRALKNGETPVACIFVHEPTHTILSFGCNDTNGSLNGTMHAEFVAIEKILQGFNLYKKGREEIIEFFMDVTLYVTVEPC

SEQ ID NO: 533 - protein, 155 aa, Artificial Sequence
  source: /note="Description of Artificial Sequence: Synthetic polypeptide"
MSDDIAFMQQALELAREAASLGEVPVGAVAVLDGNVVGTGYNRRECDRNPFAHAEMLALAAAAKARDAWRLSGVTLYVTLEPCAMCAGALVQSRVTRLVFGTMDPKAGAVGSLYNLVEEPRHNHRLQVTSGILAEDSRQLLKTFFERLRAKRREN

SEQ ID NO: 534 - protein, 161 aa, Artificial Sequence
  source: /note="Description of Artificial Sequence: Synthetic polypeptide"
MVDQMTDEYYMGLALAEAQAAFQIGEVPIGAVIVMDGQVVAAGHNLRETWHDATAHAEIIAIRQACERLSRWRLTGATLYVTIEPCPMCAGALIMSRIDRLVYGSSDYKAGAVESIFNIVQNEALNHQLAVTAGVRAEECARIMRDFFRMRRSGEMRSISE

SEQ ID NO: 535 - protein, 159 aa, Artificial Sequence
  source: /note="Description of Artificial Sequence: Synthetic polypeptide"
MTKDEFYMGKALEEAKKAAAVGEIPIGAVIVHKKKAVARAHNLRETLPCATAHAELLAIAEACRVLGRWRLTGCTLYVTVEPCPMCAGAIVNSRLDRVVYGCADTKGGGTRSLYKIVDDERLNHRAIVTAGIRETECAALLKDFFRKRRAEEKRKTVSD

SEQ ID NO: 536 - protein, 168 aa, Artificial Sequence
  source: /note="Description of Artificial Sequence: Synthetic polypeptide"
MERHEHYMRLAMQEAKKAEAIGEVPIGCVIVKGDEVIASGYNHRETNRQATAHAELLAIEAACEKLANWRLEGCELYVTLEPCPMCAGAIMLSRIEHVIFGAVDPKGGCCGTLMNLVQDDRFNHVSQLTGGILEQECGEMLTSFFRELRAKKKQQKRAMGCNATNETV

SEQ ID NO: 537 - protein, 176 aa, Artificial Sequence
  source: /note="Description of Artificial Sequence: Synthetic polypeptide"
MHTCIILPNKPTIIKSAVEKDDVWWMGSAIREAEKAAERGEVPIGAVIVRDGKIISRGYNLREGKQDPAAHAELIAIRKAAKKLGNWRLAGTTLYVTLEPCIMCMGAILLARVEKVVFGCYDPKGGAAGSLYDLSDDKRLNHRVTLVAGIRQAECAALLSGFFAALRAEKKRAKLQ

SEQ ID NO: 538 - protein, 156 aa, Artificial Sequence
  source: /note="Description of Artificial Sequence: Synthetic polypeptide"
MEDSTGKHEYFMRQALAEARKAAEKDEVPIGAVIVYENHIIARAHNQREMLNDPTAHAEMIAITQAAAHLQNWRLTGTTIYVTLEPCAMCAGALVQSRIDTLVYGTPDKKAGACASVINLVQEPRFNHRLNVLSNVLADECKHILQKFFLENCRTK

SEQ ID NO: 539 - protein, 176 aa, Artificial Sequence
  source: /note="Description of Artificial Sequence: Synthetic polypeptide"
MFSSEEKKHYMELAFAEAEKAEAQDEVPIGAIVVAPDGQVIGRGYNRRELDNIATHHAEILAINEACKNLNSWRLIDCSLFVTLEPCAMCAGAIINARLKEVFYGAPDHKAGASGSVVDLFAVEKFNHHPQVIRGLYSEKASNMLTNFFRAIRAKQKEKKLKAKTKENDASPSQID

SEQ ID NO: 540 - protein, 172 aa, Artificial Sequence
  source: /note="Description of Artificial Sequence: Synthetic polypeptide"
MSKGDSDQKYMQQAIQLALQAQAQGEVPIGALLVKDDKIVAQAYNLRENNQDATAHAELMVIQAACKQLNSWRLTGCTLYVTLEPCVMCAGALVLSRVERVVYGALDPKAGAVHSLFNILTHPLLNHQIEVQGGVCEAECRQLLKNFFQQRRQENKLKKQMRQNVSLEREVE

SEQ ID NO: 541 - protein, 151 aa, Artificial Sequence
  source: /note="Description of Artificial Sequence: Synthetic polypeptide"
MDDFAYMRQAMELAEQAAALGEIPVGALVVQDATGEVLGRGYNRREVDHDPTAHAEVLAIRQAALAIGSWRLSGCTLYVTLEPCPMCCGTIINARVRRVVFGAYDSKAGSADSVINLFALPYNHKPAVTGGLLEDACKEQLQRFFSGLREK

SEQ ID NO: 542 - protein, 160 aa, Artificial Sequence
  source: /note="Description of Artificial Sequence: Synthetic polypeptide"
MEDQDHYFMEQALAEAKKAEEIGEVPIGAVVVKDGRVIATAHNLRESKQQATAHAEVLAIEQASLETGFWRLDDCALYVTLEPCPMCAGAILQSRISKLVYGAKDPKAGCVHSLYSLLEDPRFNHQVEVIAGVNEEECGERLTQFFRQLRANKREKKSES

SEQ ID NO: 543 - protein, 180 aa, Artificial Sequence
  source: /note="Description of Artificial Sequence: Synthetic polypeptide"
MVGKKMNITYNDDDYMKEAIEEAKKAGELGEVPIGAVVVLDGKIISRAHNLRESNQNAVAHAELLAIEEACGMLGTWRLEDAALYVTLEPCAMCSGAIILSRIKRVVYGAADPKGGCAGTFMNLLQDERFNHQSEVSAGVLEEECGSLLTDFFRALRERKKEEKRRRKQLLDLQEGIDRP

SEQ ID NO: 544 - protein, 108 aa, Artificial Sequence
  source: /note="Description of Artificial Sequence: Synthetic polypeptide"
MVGCVFVYQGKIIGRGMNATNRTLNGTRHAEFMAISHILSPPAYSEDKAYPPTVFHDTDLYVTVEPCIMCASLLRQFGIRKVYFGASNDKFGGTGGVLNIHADEDIGN

SEQ ID NO: 545 - protein, 185 aa, Artificial Sequence
  source: /note="Description of Artificial Sequence: Synthetic polypeptide"
MVEAGVTAASAATAATAASATSAAAFLPWTEEDARYIRLALEEAQAAYDIGEVPVGALVVSAKGEILGRGYNRTIIDHDPTAHAEIVALRNAARQLENYRLPGITVYVTLEPCVMCIGAMLHARLARVVFGAYDPKTGACGSVLDVGAVPKLNHHTSVTGGVLAEPCGDLLRRFFRERRAKESIA

SEQ ID NO: 546 - protein, 16 aa, Artificial Sequence
  source: /note="Description of Artificial Sequence: Synthetic peptide"
SGSETPGTSESATPES

SEQ ID NO: 547 - protein, 1072 aa, Artificial Sequence
  source: /note="Description of Artificial Sequence: Synthetic polypeptide"
MSELDYRIGLAIGTNSIGWGVIELFWNKDRERYEKVRIVDKGVRMFDKAEIPNKGASLAEPRRIARSSRRRLNRKSQRKKEIRNLLVQHGMITQEELDLLYPLSKKSIDIWDIRLDGLDRLLNHLEWARLLIHLAQRRGFKSNRKSELKDAETGKVLSSIQVNEKRLFLYRTVGEMWIKDAEFSKYDRRRNSPNEYVFSVSRADLEKEIVTLFEAQRKFQSSYASKNLQETYLQIWAHQLPFASGNAILNKVGYCSLLKGKERRIPKATYTFQYFSALDQVNRTRLGPDFQPFTQEQKEIILDKMFQRTDYYKKKTIPEVSYYDIRKWLELDETIQFKGLNYDPNEELKKIEKKPFINLKAFYEIKKVVANYAERTNEAFSTLDYDAIAYALTVYKTDKDIRSYLKKSNNLSKRCYDDQLIEELFTLSYTKFGHLSFKAINHVLPIMQEGRTYQEAIHQLGYDTTNLKKENRSMFLPLIPDEITNPIVKRAITQARKVVNAIIRRYGSPNSVHIALARELSKSHDERKKIMTAHDENYKKNKGAISILIENGILNPTGYDIVRYKLWKEQGERCAYSLKEIPPDTFFNELKKERNGSPILEVDHILPYSQSFIDSYHNKVLVYSDENRNKGNRIPYTYFLETNKDWEAFERYVRSNKLFSKKKREYLLKKTYLPRESELIKERHLNDTRYASTFLKNFIEQNLQFKEVEVNLRKKRVQTVNGVITAHLRKRWGLEKNRQETYLHHAMDAIIVACTDHHMVTRITEYYQIKESNKSVKKPYFPMPWEGFRDELLSHLASQPIAKKISEELKAGYQSSDYIFVSRMPKRSVTGAAHDQTIRRKGGIDKKGKTIIIKRVRLKDIKFDENGDFKMVGKEQDLATYEAIKQRYLEHRKNSKKAFETPLYKPSKKGTGNLIKRVKIEGQTKAFVREVNGGVAQNSDLVRVDLFEKDDKYYMVPIYVPDTVCSELPKKVVKSGKGYEQWLTLDNSFTFKSSLYPYDLVRLVKGNEDRFLYFGTLDIDSDRLNFKDVNKPSKQNEYRYSLKTIENLEKYEVGVLGDLRLVKQETRRIFNR

SEQ ID NO: 548 - protein, 7 aa, Artificial Sequence
  source: /note="Description of Artificial Sequence: Synthetic peptide"
ENLYFQS

SEQ ID NO: 549 - DNA, 135 bp, Artificial Sequence
  source: /note="Description of Artificial Sequence: Synthetic polynucleotide"
aggagcgaaggcatgaaaccatatcgtcatagttccatgaaagccaaaagtggctttgatgtttctatgataagggtttcggcccgtggcgtcggggatcgcctgcccattccgatgggcttctccccatttatt

SEQ ID NO: 550 - DNA, 135 bp, Artificial Sequence
  source: /note="Description of Artificial Sequence: Synthetic polynucleotide"
acgcacaaacgtcgtatctccgcacgtcatagttccatgaaagccaaaagtggctttgatgtttctatgataagggtttcggcccgtggcgtcggggatcgcctgcccattccgatgggcttctccccatttatt

SEQ ID NO: 551 - DNA, 135 bp, Artificial Sequence
  source: /note="Description of Artificial Sequence: Synthetic polynucleotide"
tatctccgcactcggcccaggcggtgtcatagttccatgaaagccaaaagtggctttgatgtttctatgataagggtttcggcccgtggcgtcggggatcgcctgcccattccgatgggcttctccccatttatt

SEQ ID NO: 552 - DNA, 135 bp, Artificial Sequence
  source: /note="Description of Artificial Sequence: Synthetic polynucleotide"
cagctgtctcagtttatggaccagagtcatagttccatgaaagccaaaagtggctttgatgtttctatgataagggtttcggcccgtggcgtcggggatcgcctgcccattccgatgggcttctccccatttatt

SEQ ID NO: 553 - protein, 1071 aa, Artificial Sequence
  source: /note="Description of Artificial Sequence: Synthetic polypeptide"
MRELDYRIGLAIGTNSIGWGVIELSWNKDRERYEKVRIVDQGVRMFDRAEMPKTGASLAEPRRIARSSRRRLNRKSQRKKNIRNLLVQHGVITQEELDSLYPLSKKSMDIWGIRLDGLDRLLNHFEWARLLIHLAQRRGFKSNRKSELKDTETGKVLSSIQLNEKRLSLYRTVGEMWMKDPDFSKYDRKRNSPNEYVFSVSRAELEKEIVTLFAAQRRFQSPYASKDLQETYLQIWTHQLPFASGNAILNKVGYCSLLKGKERRIPKATYTFQYFSALDQVNRTRLGPDFQPFTKEQREIILNNMFQRTDYYKKKTIPEVTYYDIRKWLELDETIQFKGLNYDPNEELKKIEKKPFINLKAFYEINKVVANYSERTNETFSTLDYDGIGYALTVYKTDKDIRSYLKSSHNLPKRCYDDQLIEELLSLSYTKFGHLSLKAINHVLSIMQKGNTYKEAVDQLGYDTSGLKKEKRSKFLPPISDEITNPIVKRALTQARKVVNAIIRRHGSPHSVHIELARELSKNHDERTKIVSAQDENYKKNKGAISILSEHGILNPTGYDIVRYKLWKEQGERCAYSLKEIPADTFFNELKKERNGAPILEVDHILPYSQSFIDSYHNKVLVYSDENRKKGNRIPYTYFLETNKDWEAFERYVRSNKFFSKKKREYLLKRAYLPRESELIKERHLNDTRYASTFLKNFIEQNLQFKEAEDNPRKRRVQTVNGVITAHFRKRWGLEKDRQETYLHHAMDAIIVACTDHHMVTRVTEYYQIKESNKSVKKPYFPMPWEGFRDELLSHLASQPIAKKISEELKAGYQSLDYIFVSRMPKRSITGAAHKQTIMRKGGIDKKGKTIIIERLHLKDIKFDENGDFKMVGKEQDMATYEAIKQRYLEHGKNSKKAFETPLYKPSKKGTGNLIKRVKVEGQAKSFVREVNGGVAQNGDLVRVDLFEKDDKYYMVPIYVPDTVCSELPKKVVASSKGYEQWLTLDNSFTFKFSLYPYDLVRLVKGDEDRFLYFGTLDIDSDRLNFKDVNKPSKKNEYRYSLKTIEDLEKYEVGVLGDLRLVRKETRRNFH

SEQ ID NO: 554 - protein, 213 aa, Artificial Sequence
  source: /note="Description of Artificial Sequence: Synthetic polypeptide"
MNPQIRNPMEGMDRHAFNYNFENEPILYGRSYTWLCYEVKIRKDPSKLPWDTGVFRGQVRPKLQSNRRYELSNWECRKHVYFQPQYHAEMCFLSWFCGNQLPAHKRFQITWFVSWTPCPDCVAKVTEFLAEHPNVTLTISVARLYYYRGKDWRRALCRLHQAGARVKIMDYEEFAYCWENFVYNEGQSFMPWDKFDDNYAFLHHKLKEILRNP

SEQ ID NO: 555 - protein, 182 aa, Artificial Sequence
  source: /note="Description of Artificial Sequence: Synthetic polypeptide"
MEATYPHIFYFHFKNLRKAYGRNETWLCFTMEIIKQHSTVFWETGVFRNQVYPESLCHAERCFLSWFCEDILSPNTDYRVTWYTSWSPCLDCAGEVAEFLARHSNVKLAIFAARLYYFWDPHYQQGLRSLSEKGASVEIMGYKDFKYCWENFVYNGDEPFKPWKGLKYNFLFLDSKLQEILQ

SEQ ID NO: 556 - DNA, 130 bp, Artificial Sequence
  source: /note="Description of Artificial Sequence: Synthetic polynucleotide"
aggttttaatggcccagcctgtcatagttccattaaagccaaaagtggctttgatgtttctatgataagggtttcgacccgtggcgtcggggatcgcctgcccattgaaatgggcttctccccatttatt

SEQ ID NO: 557 - DNA, 130 bp, Artificial Sequence
  source: /note="Description of Artificial Sequence: Synthetic polynucleotide"
catggcagtacattagagcagtcatagttccattaaagccaaaagtggctttgatgtttctatgataagggtttcgacccgtggcgtcggggatcgcctgcccattgaaatgggcttctccccatttatt

SEQ ID NO: 558 - DNA, 130 bp, Artificial Sequence
  source: /note="Description of Artificial Sequence: Synthetic polynucleotide"
cacatctcgagcaagacgttgtcatagttccattaaagccaaaagtggctttgatgtttctatgataagggtttcgacccgtggcgtcggggatcgcctgcccattgaaatgggcttctccccatttatt

SEQ ID NO: 559 - DNA, 130 bp, Artificial Sequence
  source: /note="Description of Artificial Sequence: Synthetic polynucleotide"
cttctatagcctccttccccgtcatagttccattaaagccaaaagtggctttgatgtttctatgataagggtttcgacccgtggcgtcggggatcgcctgcccattgaaatgggcttctccccatttatt

SEQ ID NO: 560 - DNA, 130 bp, Artificial Sequence
  source: /note="Description of Artificial Sequence: Synthetic polynucleotide"
cctgaatgctgtgcggctctgtcatagttccattaaagccaaaagtggctttgatgtttctatgataagggtttcgacccgtggcgtcggggatcgcctgcccattgaaatgggcttctccccatttatt

SEQ ID NO: 561 - DNA, 130 bp, Artificial Sequence
  source: /note="Description of Artificial Sequence: Synthetic polynucleotide"
gccgcacagcattcaggtcggtcatagttccattaaagccaaaagtggctttgatgtttctatgataagggtttcgacccgtggcgtcggggatcgcctgcccattgaaatgggcttctccccatttatt

SEQ ID NO: 562 - DNA, 4923 bp, Artificial Sequence
  source: /note="Description of Artificial Sequence: Synthetic polynucleotide"
gccaccatggtgtctaagggcgaggaactgttcaccggcgtggtgcccatcctggtggaactggacggggatgtgaacggccacaagttcagcgtgtccggcgagggagagggcgacgccacatacggcaagctgaccctgaaattcatctgcaccacaggaaagctccccgtgccttggcctaccctggtcaccaccctgacgcatggcgtgcaatgtttcagccgctaccccgaccacatgaaacagcacgactttttcaaaagcgccatgcctgagggctacgtgcaagagcggaccatcttcttcaaggacgacggaaattacaagaccagagccgaggtgaagttcgagggcgacaccctggtgaatagaatcgagctgaagggcatcgacttcaaggaagatggcaacatcctgggccacaagctggaatacaactacaacagccacaacgtgtacatcatggccgacaagcagaagaacggcatcaaggtgaacttcaagatcagacacaacatcgaggacggcagcgtgcaactggccgatcattaccagcagaacacccctatcggcgatggtcctgtgctgctgcctgacaaccactacctgagcacccagagcgccctgtctaaagatcctaacgagaagcgggaccacatggtcctgctggaattcgtgaccgccgctggcataacactcggcatggacgagctgtacaagtaaggatccgcaggcctctgctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtggcgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgc

SEQ ID NO: 563 - DNA, 140 bp, Artificial Sequence
  source: /note="Description of Artificial Sequence: Synthetic polynucleotide"
accctgacgcatggcgtgcaatgttgtcatagttccatgaaagccaaaagtggctttgatgtttctatgataagggtttcggcccgtggcgtcggggatcgcctgcccattccgatgggcttctccccatttattttttt

SEQ ID NO: 564 - DNA, 4923 bp, Artificial Sequence
  source: /note="Description of Artificial Sequence: Synthetic polynucleotide"
cgctcatttgctcgtcgggcatcgaatctcgtcagctatcgtcagcttacctttttggcagcgatcgcggctcccgacatcttggaccattagctccacaggtatcttcttccctctagtggtcataacagcagcttcagctacctctcaattcaaaaaacccctcaagacccgtttagaggccccaaggggttatgctatcaatcgttgcgttacacacacaaaaaaccaacacacatccatcttcgatggatagcgattttattatctaactgctgatcgagtgtagccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgcgccaccatggtgtctaagggcgaggaactgttcaccggcgtggtgcccatcctggtggaactggacggggatgtgaacggccacaagttcagcgtgtccggcgagggagagggcgacgccacatacggcaagctgaccctgaaattcatctgcaccacaggaaagctccccgtgccttgacctaccctggtcaccaccctgacgtacggcgtgcaatgtttcagccgctaccccgaccacatgaaacagcacgactttttcaaaagcgccatgcctgagggctacgtgcaagagcggaccatcttcttcaaggacgacggaaattacaagaccagagccgaggtgaagttcgagggcgacaccctggtgaatagaatcgagctgaagggcatcgacttcaaggaagatggcaacatcctgggccacaagctggaatacaactacaacagccacaacgtgtacatcatggccgacaagcagaagaacggcatcaaggtgaacttcaagatcagacacaacatcgaggacggcagcgtgcaactggccgatcattaccagcagaacacccctatcggcgatggtcctgtgctgctgcctgacaaccactacctgagcacccagagcgccctgtctaaagatcctaacgagaagcgggaccacatggtcctgctggaattcgtgaccgccgctggcataacactcggcatggacgagctgtacaagtaaggatccgcaggcctctgctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtattggcccatctctatcggtatcgtagcataaccccttggggcctctaaacgggtcttgaggggttttttgtgcccctcgggccggattgctatctaccggcattggcgcagaaaaaaatgcctgatgcgacgctgcgcgtcttatactcccacatatgccagattcagcaacggatacggcttccccaacttgcccacttccatacgtgtcctccttaccagaaatttatccttaaggtcgtcagctatcctgcaggcgatctctcgatttcgatcaagacattcctttaatggtcttttctggacaccactaggggtcagaagtagttcatcaaactttcttccctccctaatctcattggttaccttgggctatcgaaacttaattaaccagtcaagtcagctacttggcgagatcgacttgtctgggtttcgactacgctcagaattgcgtcagtcaagttcgatctggtccttgctattgcacccgttctccgattacgagtttcatttaaatcatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcatttaaatttccgaactctccaaggccctcgtcggaaaatcttcaaacctttcgtccgatccatcttgcaggctacctctcgaacgaactatcgcaagtctcttggccggccttgcgccttggctattgcttggcagcgcctatcgccaggtattactccaatcccgaatatccgagatcgggatcacccgagagaagttcaacctacatcctcaatcccgatctatccgagatccgaggaatatcgaaatcggggcgcgcctggtgtaccgagaacgatcctctcagtgcgagtctcgacgatccatatcgttgcttggcagtcagccagtcggaatccagcttgggacccaggaagtccaatcgtcagatattgtactcaagcctggtcacggcagcgtaccgatctgtttaaacctagatattgatagtctgatcggtcaacgtataatcgagtcctagcttttgcaaacatctatcaagagacaggatcagcaggaggctttcgcatgagtattcaacatttccgtgtcgcccttattcccttttttgcggcattttgccttcctgtttttgctcacccagaaacgctggtgaaagtaaaagatgctgaagatcagttgggtgcgcgagtgggttacatcgaactggatctcaacagcggtaagatccttgagagttttcgccccgaagaacgctttccaatgatgagcacttttaaagttctgctatgtggcgcggtattatcccgtattgacgccgggcaagagcaactcggtcgccgcatacactattctcagaatgacttggttgagtattcaccagtcacagaaaagcatcttacggatggcatgacagtaagagaattatgcagtgctgccataaccatgagtgataacactgcggccaacttacttctgacaacgattggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaaccttgcgtaaactattaactggcgaactacttactctagcttcccggcaacagttgatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaccgattctaggtgcattggcgcagaaaaaaatgcctgatgcgacgctgcgcgtcttatactcccacatatgccagattcagcaacggatacggcttccccaacttgcccacttccatacgtgtcctccttaccagaaatttatccttaagatcccgaatcgtttaaactcgactctggctctatcgaatctccgtcgtttcgagcttacgcgaacagccgtgg

SEQ ID NO: 565 - DNA, 2714 bp, Artificial Sequence
  source: /note="Description of Artificial Sequence: Synthetic polynucleotide"
ctccaataactgtgatccaccacaagcgccagggttttcccagtcacgacgttgtaaaacgacggccagtcatgcataatccgcacgcatctggaataaggaagtgccattccgcctgaccttgtacaaaaaagcaggctttaaaggaaccaattcagtcgactggatccggtaccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcccgtgccttgacctaccctggtcagtcatagttccatgaaagccaaaagtggctttgatgtttctatgataagggtttcggcccgtggcgtcggggatcgcctgcccattccgatgggcttctccccatttatttttttctagacccagctttcttgtacaaagttggcattaaggctaggtggaggctcagtgatgataagtctgcgatggtggatgcatgtgtcatggtcatagctgtttcctgtgtgaaattgttatccgctcagagggcacaatcctattccgcgctatccgacaatctccaagacattaggtggagttcagttcggcgtatggcatatgtcgctggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctctattcaacaaagccgccgtcccgtcaagtcagcgtaaatgggtagggggcttcaaatcgtcctcgtgataccaattcggagcctgcttttttgtacaaacttgttgataatggcaattcaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccagatacctgaaacaaaacccatcgtacggccaaggaagt

SEQ ID NO: 566 - DNA, 663 bp, Artificial Sequence
  source: /note="Description of Artificial Sequence: Synthetic polynucleotide"
atgggtgagaaaaaaatcaccggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcgcgccgtttgtgatggcttccatgtcggcagaatgcttaatgaattacaacagtactgcgatgagtggcagggcggggcgtaa

SEQ ID NO: 567 - DNA, 663 bp, Artificial Sequence
  source: /note="Description of Artificial Sequence: Synthetic polynucleotide"
atgggtgagaaaaaaatcaccggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcactacgccgtttgtgatggcttccatgtcggcagaatgcttaatgaattacaacagtactgcgatgagtggcagggcggggcgtaa

SEQ ID NO: 568 - protein, 1368 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 569 - protein, 1368 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 570 - protein, 82 aa, Artificial Sequence
  source: /note="Description of Artificial Sequence: Synthetic polypeptide"
TNLSDHEKETGKQLVIQESILMLPEEVEEVIGNKPESDILVHTAYDESTDENVMLLTSDAPEYKPWALVIQDSNGENKIKML

SEQ ID NO: 571 - protein, 199 aa, Artificial Sequence
  source: /note="Description of Artificial Sequence: Synthetic polypeptide"
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 572 - protein, 164 aa, Artificial Sequence
  source: /note="Description of Artificial Sequence: Synthetic polypeptide"
MKTHEEYMELALEEARKAEEIDEVPVGCVIVCDGEVISRGHNLKEQLNQAYAHAEMMAIQKAAEVKGNWCLNDCDLYVTLEPCMMCTGIINLSRIRTVYYGKQYPTGGCLETVIDLKKINRLNHYPNIVGNILQKECSEILTNYFRKKREIIKEKKQKNKANIQ

SEQ ID NO: 573 - protein, 154 aa, Artificial Sequence
  source: /note="Description of Artificial Sequence: Synthetic polypeptide"
MLEDFMRVALEEAKKAYKQGEVPVGAVIVKNGKVISKAHNETRQKKNAVAHAEILAIDKACKKLENERLVDTEMYVTLEPCAMCAGAILQARIPRLLFGAENPKAGFCGSVLDILQLSALNHRVELLPPVLREDCKRLMTDFFGRLRAHSDSEE

SEQ ID NO: 574 - protein, 160 aa, Artificial Sequence
  source: /note="Description of Artificial Sequence: Synthetic polypeptide"
MEQENYMRRALTLAREAGDAGEVPVGCVIVRDGKVVGEGRNRREELTSAASHAEMEAIAAANERLGSWRLEGCALYVTLEPCPMCAGAILNARVSKVFYGERSPKFGACGGVTNLFMEDFPNRPALVGGVLAEECREVLRAFFQKLRNDGGTGESPEPKI

SEQ ID NO: 575 - protein, 152 aa, Artificial Sequence
  source: /note="Description of Artificial Sequence: Synthetic polypeptide"
MDRYMTRALELARLAFDEGEVPVGAVVVKKTTGEIIGEGRNMREGAKNALAHAEIIAIDQACRTLGGWRLPECAIYVTLEPCPMCCGAIINARIDNVIFGKYLLESGSAASVQKMFELPYNYRPEVTGGIMEQECADILSEFFRQLRIRKKT

SEQ ID NO: 576 - protein, 155 aa, Artificial Sequence
  source: /note="Description of Artificial Sequence: Synthetic polypeptide"
MENNDEKFMMKAIEQAKIAYDMDEVPVGCVIVKDGEIIAQAYNSVEKDKNATMHAELKAINQATEFIGNFRLDDCIMYVTLEPCVMCTGALVYSRIPKVVFGAFAKRRGACGSLISLNDYEGLNHKIEVKSIMEKECVELMQSFFRRIREKNRNK

SEQ ID NO: 577 - protein, 169 aa, Artificial Sequence
  source: /note="Description of Artificial Sequence: Synthetic polypeptide"
MTEHEKFMNAALKLARKAAAEGEVPVGCVVVRDGVIVGRGRNRRETKKDALGHAEIEAIHKACKKLGGWRLHQCDLYVTLEPCPMCTGAIINARIKTVYYGGPSLRAGSCGSVVNLFDLPYNHKPELVSGLMEQECTEELQKFFRQLRERKKLEKQLRKQAQMNDLNEI

SEQ ID NO: 578 - protein, 151 aa, Artificial Sequence
  source: /note="Description of Artificial Sequence: Synthetic polypeptide"
MDDFAYMRQAMELAEQAAALGEIPVGALVVQDATGEVLGRGYNRREVDHDPTAHAEVLAIRQAALAIGSWRLSGCTLYVTLEPCPMCCGTIINARVRRVVFGAYSSTAGSADSVINLFALPYNHKPAVTGGLLEDACKEQLQRFFSGLREK

SEQ ID NO: 579 - protein, 169 aa, Artificial Sequence
  source: /note="Description of Artificial Sequence: Synthetic polypeptide"
MTEHEKFMNAALKLARKAAAEGEVPVGCVVVRDGVIVGRGRNRRETKKDALGHAEIEAIHKACKKLGGWRLHQCDLYVTLEPCPMCTGAIINARIKTVYYGSPQLGAGSCGSVVNLFDLPYNHKPELVSGLMEQECTEELQKFFRQLRERKKLEKQLRKQAQMNDLNEI

SEQ ID NO: 580 - protein, 168 aa, Artificial Sequence
  source: /note="Description of Artificial Sequence: Synthetic polypeptide"
MEKEEASLQGIHERWMRQALEEADKAEQLNEVPIGAIIVKDQQIIGRGYNVRETQHQATGHAEIQAIEDANRHQQAWRLEGATMYVTLEPCPMCAGALINSRIQTVVYGASGLKAGCAGTLMNLLQDDRFNHQVEVISGVLAEECGDKLSYFFRKLRQRKGKNIDRAE

SEQ ID NO: 581 - protein, 158 aa, Artificial Sequence
  source: /note="Description of Artificial Sequence: Synthetic polypeptide"
MTRDEMYMRKALELAALAADEDEVPVGAVVVKKSTGEIVGRGFNRREYGRSPLTHAEIVAIDEASRKLGGWRLIDCELFVTLEPCPMCAGAVINSRVERVVFGQYGKRAGSCGSVVDLFGLPYNHKPECIGGVLEEECAAVLTEFFKGLRKRKVKVNE

SEQ ID NO: 582 - protein, 164 aa, Artificial Sequence
  source: /note="Description of Artificial Sequence: Synthetic polypeptide"
MKTHEEYMELALEEARKAEEIDEVPVGCVIVCDGEVISRGHNLKEQLNQAYAHAEMMAIQKAAEVKGNWCLNDCDLYVTLEPCMMCTGIINLSRIRTVYYGRQWPEGGCLETVIDLKKINRLNHYPNIVGNILQKECSEILTNYFRKKREIIKEKKQKNKANIQ

SEQ ID NO: 583 - protein, 169 aa, Artificial Sequence; identical to SEQ ID NO: 325
  source: /note="Description of Artificial Sequence: Synthetic polypeptide"

SEQ ID NO: 584 - protein, 168 aa, Artificial Sequence
  source: /note="Description of Artificial Sequence: Synthetic polypeptide"
MEKEEASLQGIHERWMRQALEEADKAEQLNEVPIGAIIVKDQQIIGRGYNVRETQHQATGHAEIQAIEDANRHQQAWRLEGATMYVTLEPCPMCAGALINSRIQTVVYGFSSLTAGCAGTLMNLLQDDRFNHQVEVISGVLAEECGDKLSYFFRKLRQRKGKNIDRAE

SEQ ID NO: 585 - protein, 150 aa, Artificial Sequence
  source: /note="Description of Artificial Sequence: Synthetic polypeptide"
  SITE (1)..(150): /note="This sequence may encompass 1-30 'Gly Gly Gly Gly Ser' repeating units"
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 586 - protein, 30 aa, Artificial Sequence
  source: /note="Description of Artificial Sequence: Synthetic polypeptide"
  SITE (1)..(30): /note="This sequence may encompass 1-30 residues"
GGGGGGGGGGGGGGGGGGGGGGGGGGGGGG

SEQ ID NO: 587 - protein, 150 aa, Artificial Sequence
  source: /note="Description of Artificial Sequence: Synthetic polypeptide"
  SITE (1)..(150): /note="This sequence may encompass 1-30 'Glu Ala Ala Ala Lys' repeating units"
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 588 - protein, 60 aa, Artificial Sequence
  source: /note="Description of Artificial Sequence: Synthetic polypeptide"
  SITE (1)..(60): /note="This sequence may encompass 1-30 'Xaa Pro' repeating units"
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
XPXPXPXPXPXPXPXPXPXPXPXPXPXPXPXPXPXPXPXPXPXPXPXPXPXPXPXPXPXP

SEQ ID NO: 589 - protein, 36 aa, Artificial Sequence
  source: /note="Description of Artificial Sequence: Synthetic polypeptide"
  MOD_RES (2)..(2): Any amino acid
  MOD_RES (4)..(29): Any amino acid
  SITE (4)..(29): /note="This region may encompass 23-26 residues"
  MOD_RES (32)..(35): Any amino acid
  SITE (32)..(35): /note="This region may encompass 2-4 residues"
HXEXXXXXXXXXXXXXXXXXXXXXXXXXXPCXXXXC

SEQ ID NO: 590 - protein, 5 aa, Artificial Sequence
  source: /note="Description of Artificial Sequence: Synthetic peptide"
GGGGS

SEQ ID NO: 591 - protein, 5 aa, Artificial Sequence
  source: /note="Description of Artificial Sequence: Synthetic peptide"
EAAAK

SEQ ID NO: 592 - protein, 80 aa, Artificial Sequence
  source: /note="Description of Artificial Sequence: Synthetic polypeptide"
  SITE (1)..(80): /note="This sequence may encompass 1-20 'Ser Gly Gly Ser' repeating units"
SGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 593 - protein, 6 aa, Artificial Sequence
  source: /note="Description of Artificial Sequence: Synthetic 6xHis tag"
HHHHHH

SEQ ID NO: 594 - protein, 10 aa, Artificial Sequence
  source: /note="Description of Artificial Sequence: Synthetic 10xHis tag"
HHHHHHHHHH

SEQ ID NO: 595 - DNA, 41 bp, Artificial Sequence
  source: /note="Description of Artificial Sequence: Synthetic oligonucleotide"
gtctgattgcctgtcgttgcccctcccaaggagttggcaga

SEQ ID NO: 596 - DNA, 69 bp, Artificial Sequence
  source: /note="Description of Artificial Sequence: Synthetic oligonucleotide"
gtctgattgcctgtcgttgcccctaagtgtattaagcattgtctcagagattttggaggagttggcaga

SEQ ID NO: 597 - DNA, 39 bp, Artificial Sequence
  source: /note="Description of Artificial Sequence: Synthetic oligonucleotide"
gtctgattgcctgtcgttgcccctggaggagttggcaga

SEQ ID NO: 598 - DNA, 47 bp, Artificial Sequence
  source: /note="Description of Artificial Sequence: Synthetic oligonucleotide"
gtctgattgcctgtcgttgcccctcccagatcggaggagttggcaga

SEQ ID NO: 599 - DNA, 44 bp, Artificial Sequence
  source: /note="Description of Artificial Sequence: Synthetic oligonucleotide"
gtctgattgcctgtcgttgcccctcccagataggagttggcaga

SEQ ID NO: 600 - DNA, 39 bp, Artificial Sequence
  source: /note="Description of Artificial Sequence: Synthetic oligonucleotide"
gtctgattgcctgtcgttgcccatctgggagttggcaga

SEQ ID NO: 601 - DNA, 41 bp, Artificial Sequence
  source: /note="Description of Artificial Sequence: Synthetic oligonucleotide"
gtctgattgcctgtcgttgcccctctggaggagttggcaga

SEQ ID NO: 602 - DNA, 23 bp, Artificial Sequence
  source: /note="Description of Artificial Sequence: Synthetic oligonucleotide"
gtctgattggaggagttggcaga

SEQ ID NO: 603 - DNA, 40 bp, Artificial Sequence
  source: /note="Description of Artificial Sequence: Synthetic oligonucleotide"
gtctgattgcctgtcgttgcccctcggaggagttggcaga

SEQ ID NO: 604 - DNA, 42 bp, Artificial Sequence
  source: /note="Description of Artificial Sequence: Synthetic oligonucleotide"
gtctgattgcctgtcgttgcccctccaggaggagttggcaga

SEQ ID NO: 605 - DNA, 34 bp, Artificial Sequence
  source: /note="Description of Artificial Sequence: Synthetic oligonucleotide"
gtctgattgcctgtcgttgcccggagttggcaga

SEQ ID NO: 606 - DNA, 42 bp, Artificial Sequence
  source: /note="Description of Artificial Sequence: Synthetic oligonucleotide"
gtctgattgcctgtcgttgcccatcatggaggagttggcaga

SEQ ID NO: 607 - DNA, 43 bp, Artificial Sequence
  source: /note="Description of Artificial Sequence: Synthetic oligonucleotide"
gtctgattgcctgtcgttgcccctccatggaggagttggcaga

SEQ ID NO: 608 - DNA, 33 bp, Artificial Sequence
  source: /note="Description of Artificial Sequence: Synthetic oligonucleotide"
gtctgattgcctgtcgttgcccctcccagtact

SEQ ID NO: 609 - DNA, 44 bp, Artificial Sequence
  source: /note="Description of Artificial Sequence: Synthetic oligonucleotide"
gtctgattgcctgtcgttgccccaatcttggaggagttggcaga

SEQ ID NO: 610 - DNA, 43 bp, Artificial Sequence
  source: /note="Description of Artificial Sequence: Synthetic oligonucleotide"
gtctgattgcctgtcgttgccctgggatggaggagttggcaga

SEQ ID NO: 611 - DNA, 35 bp, Artificial Sequence
  source: /note="Description of Artificial Sequence: Synthetic oligonucleotide"
gtctgattgcctgtcgttgcccctcagttggcaga

SEQ ID NO: 612 - DNA, 42 bp, Artificial Sequence
  source: /note="Description of Artificial Sequence: Synthetic oligonucleotide"
gtctgattgcctgtcgttgcccctcatggaggagttggcaga

SEQ ID NO: 613 - protein, 53 aa, Artificial Sequence
  source: /note="Description of Artificial Sequence: Synthetic polypeptide"
  VARIANT (1)..(1): /replace="His" or "Cys"
  MOD_RES (2)..(2): Any amino acid
  MOD_RES (4)..(48): Any amino acid
  SITE (4)..(48): /note="This region may encompass 15-45 residues"
  MOD_RES (51)..(52): Any amino acid
  SITE (1)..(53): /note="Variant residues given in the sequence have no preference with respect to those in the annotations for variant positions"
DXEXXXXXXXXXXXXXXXXXXXXXXXXXXXXXXXXXXXXXXXXXXXXXPCXXC

SEQ ID NO: 614 - protein, 4 aa, Artificial Sequence
  source: /note="Description of Artificial Sequence: Synthetic peptide"
EEQL

SEQ ID NO: 615 - protein, 6 aa, Artificial Sequence
  source: /note="Description of Artificial Sequence: Synthetic peptide"
AEVSQA

SEQ ID NO: 616 - protein, 4 aa, Artificial Sequence
  source: /note="Description of Artificial Sequence: Synthetic peptide"
GEQL

SEQ ID NO: 617 - protein, 6 aa, Artificial Sequence
  source: /note="Description of Artificial Sequence: Synthetic peptide"
AEVSKA

That which is claimed:

1. A nucleic acid molecule comprising a polynucleotide encoding an RNA-guided nuclease (RGN) polypeptide, wherein said RGN polypeptide comprises an amino acid sequence:
   (i) having at least 90% sequence identity to SEQ ID NO: 1;
   (ii) having at least 93% sequence identity to SEQ ID NO: 16;
   (iii) having at least 99% sequence identity to SEQ ID NO: 24; or
   (iv) having at least 92% sequence identity to SEQ ID NO: 35;
   wherein said polynucleotide encoding an RGN polypeptide is operably linked to a promoter heterologous to said polynucleotide.

2. The nucleic acid molecule of claim 1, wherein the RGN polypeptide is operably fused to a base-editing polypeptide.

3. The nucleic acid molecule of claim 1, wherein said RGN polypeptide is nuclease dead or functions as a nickase.

4. The nucleic acid molecule of claim 1, wherein said RGN polypeptide comprises an amino acid sequence having at least 95% sequence identity to SEQ ID NO: 1, 16, or 35.

5. The nucleic acid molecule of claim 1, wherein said RGN polypeptide comprises the amino acid sequence set forth as SEQ ID NO: 1, 24, 16, or 35.

6. The nucleic acid molecule of claim 1, wherein said nucleotide sequence encoding said RGN polypeptide is codon optimized for expression in a eukaryotic cell.

7. The nucleic acid molecule of claim 2, wherein said base-editing polypeptide is a deaminase.

8. A vector comprising the nucleic acid molecule of claim 1.

9. The vector of claim 8, wherein said vector further comprises at least one nucleotide sequence encoding a guide RNA capable of hybridizing to a target sequence, and wherein the guide RNA comprises a CRISPR RNA comprising a CRISPR repeat, wherein said CRISPR repeat is capable of hybridizing to the anti-repeat of a trans-activating CRISPR RNA (tracrRNA), and wherein
   (i) said CRISPR repeat comprises a nucleotide sequence having at least 95% sequence identity to SEQ ID NO: 2, wherein said tracrRNA comprises a nucleotide sequence having at least 95% sequence identity to SEQ ID NO: 3, and wherein said RGN polypeptide comprises an amino acid sequence having at least 90% sequence identity to SEQ ID NO: 1;
   (ii) said CRISPR repeat comprises a nucleotide sequence having at least 95% sequence identity to SEQ ID NO: 17, wherein said tracrRNA comprises a nucleotide sequence having at least 95% sequence identity to SEQ ID NO: 18, and wherein said RGN polypeptide comprises an amino acid sequence having at least 9093% sequence identity to SEQ ID NO: 16;
   (iii) said CRISPR repeat comprises a nucleotide sequence having at least 95% sequence identity to SEQ ID NO: 25, wherein said tracrRNA comprises a nucleotide sequence having at least 95% sequence identity to SEQ ID NO: 26, and wherein said RGN polypeptide comprises an amino acid sequence having at least 99% sequence identity to SEQ ID NO: 24; or
   (iv) said CRISPR repeat comprises a nucleotide sequence having at least 95% sequence identity to SEQ ID NO: 36, wherein said tracrRNA comprises a nucleotide sequence having at least 95% sequence identity to SEQ ID NO: 37, and wherein said RGN polypeptide comprises an amino acid sequence having at least 92% sequence identity to SEQ ID NO: 35.

10. The vector of claim 8, wherein said vector further comprises at least one nucleotide sequence encoding a guide RNA capable of hybridizing to a target sequence, wherein the guide RNA comprises a CRISPR RNA comprising a CRISPR repeat, and wherein said CRISPR repeat comprises the nucleotide sequence set forth as SEQ ID NO: 2, 17, 25, or 36.

11. The vector of claim 8, wherein said vector further comprises at least one nucleotide sequence encoding a guide RNA capable of hybridizing to a target sequence, wherein the guide RNA comprises a trans-activating CRISPR RNA (tracrRNA), and wherein said tracrRNA comprises the nucleotide sequence set forth as SEQ ID NO: 3, 18, 26, or 37.

12. A cell comprising the nucleic acid molecule of claim 1.

13. A system for binding a target DNA sequence, said system comprising:
   a) one or more guide RNAs (gRNAs), or one or more nucleotide sequences encoding the one or more gRNAs; and
   b) the nucleic acid molecule of claim 1,
wherein said nucleotide sequences encoding the one or more guide RNAs and said polynucleotide encoding the RGN polypeptide are each operably linked to a promoter heterologous to each said nucleotide sequence and said polynucleotide.

14. The system of claim 13, wherein the target DNA sequence is within a eukaryotic cell.

15. The system of claim 13, wherein said RGN polypeptide is nuclease dead or functions as a nickase, and wherein the RGN polypeptide is operably linked to a base-editing polypeptide.

16. A method for cleaving and/or modifying a target DNA sequence in vitro, comprising delivering to the target DNA sequence:
   a) the nucleic acid molecule of claim 1, wherein the RGN polypeptide encoded by the polynucleotide is expressed and
   b) one or more guide RNAs capable of targeting the RGN of (a) to the target DNA sequence;
thereby cleaving and/or modifying said target DNA sequence.

17. The method of claim 16, wherein said RGN polypeptide is nuclease dead or functions as a nickase, and wherein the RGN polypeptide is operably linked to a base-editing polypeptide.

\* \* \* \* \*